United States Patent 12,577,609 (METHODS FOR CELL-TYPE SPECIFIC PROFILING TO IDENTIFY DRUG TARGETS) - sequence listing, part 7

SEQ ID NO: 7610 - DNA, 12634 bp, Homo sapiens
  ENST00000335154
gagccggccgcctccgtccgccttgcttcggtgcggctgtccgctacgctgcctccgccctcgccgcgcgcccccgccagcgggactccagggaacccccggcgccctcgacggggccgaggagtcgggactcggggagccggcgctgagggaggagcctggtcggagccgcggagccgaaagctccggagcgtggaggtggggggccgaggcccctgagggggccccgccgcgatgggcaacctggagagcgccgagggggtcccgggagagcccccctctgtcccgttgttgctgccgcccggcaagatgccgatgcctgagccctgtgagctggaggaaaggttcgccctggtgctgagctccatgaacctgcctccagacaaggcccggctcctgcggcagtatgacaatgagaagaaatgggatctgatctgtgaccaggaacgattccaggtgaagaatcctccccacacttacattcagaaactccagagcttcttggaccccagtgtaactcggaagaagttcaggaggagggtgcaggagtcaaccaaagtactaagggagctggagatctctcttcgcaccaaccacattgggtgggtgcgggaatttctgaatgatgaaaacaaaggcctggatgtactggtggattacctgtcctttgcccagtgttctgtcatgtttgactttgagggtctggaaagtggtgacgatggtgcatttgacaaactccggtcctggagcaggtcaatcgaggacctgcagccacccagcgccctgtcggcccccttcaccaacagcctcgctcgctctgcgcgccagtctgtgctccggtatagcactctccctgggcgcagggccctgaagaactcccgcctagtgagccagaaggatgacgtccacgtctgtatcctttgtctcagagccatcatgaactatcagtacggattcaacctggtcatgtcccacccccatgctgtcaatgagattgcacttagcctcaataacaagaatccaaggaccaaagcccttgtcttagagcttctggcagctgtgtgtttggtgcgaggaggtcacgaaatcatccttgctgcctttgacaatttcaaagaggtatgcaaggagctgcaccgctttgagaagctgatggagtatttccggaatgaggacagcaatattgacttcatggtggcctgcatgcagttcatcaacatcgtggtgcactcggtggaggacatgaacttccgggtccacctgcagtatgagtttaccaagctggggctagaggagttcctgcagaagtcaaggcacacagagagcgagaagctgcaggtgcagattcaggcatatctggacaacgtgtttgatgtcgggggtttgttggaggatgctgagaccaagaatgtagccctggagaaggtggaggagttggaggagcatgtgtcccatctcacagagaagcttctggacctagagaatgaaaacatgatgcgggtggcagaactagagaagcagctgctacagcgggagaaggaactagagagcatcaaggagacatatgagaacacaagccaccaggtgcacaccctgcggaggctcattaaagagaaggaggaggcctttcagcgtcgatgtcatttggagccaaatgtccggggcctggagtctgtggacagtgaggccctggccagagtaggccctgcagagctgagtgagggcatgccaccctccgacctggaccttctggctccagccccaccccctgaggaggtcctgcctcttcctccaccaccagctccgcccttgccccctccacctcccccattaccagacaagtgtcccccagccccacctctccctggtgctgcaccctctgtggtgttgacagtgggcctgtcagccattcgaattaagaaacctatcaagaccaagttccggctgcctgtcttcaactggacagcactgaaacccaaccagatcagtggcactgtcttcagcgaacttgatgatgagaagatcttggaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacaggcctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattggccaagggctcaggagagggctgtgttgctctctcaaccatgtccgccccagctcttgaggctggatctttctacttgtgccactatgggcactaggtctgtaggtccctggtgcttccagtactgcactttgcccccaaggtctttgacttcatttcctgaagggtcaccaagggtcagctcagggctaggaaaaaccatttccagccttagcctaaacagggcacatagatctctcccactagagcccagagggatgagaggagagagcaactgttctttctttttttttcccttcctttttgcaggcccatggtcagctctggtctagatgtatctaggcttagggagccctgggaccctgccagtctcagttcatctcttaccaggagcaaggccctctgaagcatgggccgtgccagctgtgccctagtgataagggtaagaggagagatgtcaggctcactgcccttatttctctgcccatttcattctaggctcacactgtccttgtcaaggtgggcagaagagcagaggtcttctctgcaccaaccactctctgcagatggctggagaaagggtgtgccaactcttcaccttctttcctcagctacggtttttttttttttttttttttttttggcaggggacaaggagcatggtggtcttggctatttgcttaccttcccgtttctcctctgcccctggaagggaatgtgggggcccacttttttgtacatgtaccacctccctttcctcttactgtacataaacctcagactctccccctctcaacaaaggcttgatgcaccaggcctgactttgtctcctctttctgagcttagggggctagggtggccatttagtctgacctgggctatggggatagaaaagaaatctttggggcactgcatctgttttggaggagatgagatcagaactctggggaaaggagaaccggctaggtgggctctagccacacaaagggaagcaggcctgccatgagacactagtgccctctgctgggcatgtgtccagtccccagcctgccccagtagcacatggaaaagagtcactggccatgttataaatattgttatttaaaaaacaaaaaacaaaacacacgtacattaggtcctgggtggaggaagaagtggtggagcctcagggccagggcaggcaggagcaggcactgatgctagagggtgatgaccctgccctctgccacccaggctgcgtccaacagcctgtgactcttccctggagaccccttctctcacacttttatctactggcatcacccaccccacatggcatataccacccatctctggtctggggctgagggcaaggactgcactagtccagggagtaggggacccttgaacaccaagagcaaccttgagaggtgccaacaatggtgtgctgggggtggggttactttagaaaaagtggacacagaccagactaaggaagaagtctgaggcagacggtgagggtggcccaggagccatggcctcacacagacccgaggcagagaacagctcattgggtcactggtgatcatccagctgctgtaggagtgtccgccgccgcctctccagctcaccctcactcagctcactttctgacgtgtcccagcctgtctgttggagcaaaggcacagttcacccttagcctgcactaagggccgtggaagcttgaccagcgtgctgactggcctagggcccctgcccctcaccttctccttcttgattccaaagcctggggaacggttagggagctctgcctgttggagctccctgtccttgtcctgttcttgttctttctcatcgctctccttgccagctttctcctcagggtctgtctcactctcaggactattctgtaagagtccagagcccacctcctcagttcctgtggatagcctgggaggcaggtagaacagaactcacaaaatagcaggggcttaggtagaagttccttcactcaccgacttgtgtcttctcttcttagttttcttttttggtttcttggctttccgaaggccatgatctagagatagaaaaatccctactaagtcccaacaggagaaagacaggctctttttctttgttctagcccctctgttcattcttcacaggcaggaacctcatgctctgaggaagtctaagtccagttttccttctccagcttcttgcttgggcaggtagaggaagttctttctacttccacaggtgcagccctcccaatccagtctaccctcaaaggagctggggcttgtggagggcatcctctcagtctgggacaacagttctccagcttctacgctcacagcaactgcttacctgctccaagaagatgggaggaaggggagccccgtcctccaagggcagcacccccactttcaactgaatcaagtgaggaagagggctcagagcctgactctgaggggttccgcctcctccgcttggggggccggagagatggtgggggcagctcctcttcttctgactcagagccctgggcagatcagcagatacatgtcagtgcagaggttctctgccctccagaagccctcgtctgggaattcgagagaggaggaggacccagggccaaaggaatcctcaaacttccctccaagggagatattgtaaggggaaaacaaagtgtttatttccccaaaacaacccagcttcaccccatgtcccttctacacgcttactcactgagggtgagtgggaacgcttgtgatggtgcttcttgcctttcctgccatgctttcggcctttggtgtggaggtgctggcattcagtctgctagaggcagaggaagaagggtgaggacagcaccagacttagccccaggaaggatcctacttcctaaaatctggctttgcctccctttctcagactagagccttctgcctatcccagggatcctcaggcctccccttccttagctggccaggagtgccctaagggtaagagggaggccactgaggtctctgttgaactggtctaatgagttcaagggcctgaggcagatccagaggacaagcctgcctcacctccagcacctgtaggaactcccggaagagccggatccgctccgactccagggtgatctgctcaaaggctgagtcacacacaaaacgctcacggaccttgaacgaggagagcactgctgatcagactaggccccactcagcctggcctggacaccgccatgagcacagggcagggctggggcagagaaaggaagggaactggagctggcccagggctgtgacgtgactggggtgggccctcagtggtgaagcaccgctgccctcaggcttgaggggtgcttggggccaggctacgctcctgacctcttcccaggcagtgcctagctccagagcaggcacagcctgcctcagcatgcttcgaaaggcagcttccctgcgccgcatcctgcgtgcctcctccttctcccgctccctctcccgtgcctctgctttctccagcagctgaggaaagaagggacacggaacagggtcacccaggagggtggatgccaggtcccactcaggcataccttaggaggtggaaagttagggtctgggcttctaccaccatcccctgaattgggaatatagtcagtgggacagtgagtgagaaggaatggagcaagacacagatgaattagagaacttcccacgccccgcccagcccctcacactattgaaggtcagcttgatgttgcctgcgtccagtgcggcagccctcttgtcaaagcttatgacgtgggcgaagtcctcaaaggccgtgttcacctccacgcagaagccccggtcctgtgggtacagcagtgcatgaagcaggggcaccacgtgcctgaggccaaagctggcaggcagagtggtcacattacagatggtcaagaaggcccttgcctctggaagagatccacaggactgtggtctgcattagaaaccaagttatccaagtcctcatcacttgacaattaagcccccatgcctacccttggtttggatgtcacacagagctgaaggggttgggagatgtctcccaactgctgattaatgctgagtttctcaaaattaacttttgttcctttggcttaaagctctggccccagctgggccctcctgctgctcagcagtgcttccatgcattctcaatcaacatttgctggcccctaccctttgggtctatttattgagtgcttactatgtaccaggtaccatgatgagtgtttcacacattatctcatttaatcctcttggttctacatttaagaataggtcctagtatcctaattttacacagaaggagaaaccaaggttcagagaaactagagcacttgcccaaggtctcacagctgatatacggctgggcaagaaccctaccctgggggggctctctatccccaaagtgtctgctttcaagcaccacacccacccagatgacttagtccatgggagaaacggaggccaccaggtgtgcagctccccaccaatactaaaaacatgtccacaggccaggctctatgcttctcatttaggcctcacaacattccagtgaagcagaggcttagaaaagtgatctcagttggcccaagatgacatgagtggtaaatgaagccactggagttcaaagtctggctctcacgtcagttaagcacaggccagattccctttctctccctccacatagctctcacctcctctggcctttttgctgatggcagaggtgtgctcctctttcttctttccaagggtacttcctcaaccctgctacagtccttatcaacacagcattcattctcagggaattgaaagctccaagtcacccttgttactggctccttccatcaagcagacacctcacctaacctggaacatcctttccaccatgctctccccttcatcaagctaactacctctgctcttttccattgtttcaaaacctcttgaaatgcagcagaaaggaaaaggaataaacatttattgagaacctattagacactttacagatgttatttaattctcacaaccttacctatgaattatccctgatttacaggtgagcaaacaggctcagagacacggaacttacggaggtctcagagccaataagcaaccaggagtaatctgactctaaaacatgtgctgcccccatgccacctccatgactctactctcccaaaggttgcttgtgtctactagccaaatccaaggccgccttctttgtcctcactcatctggtcctcagtgcctctaccacttacttcttcaacactcccctctccaggtcacaccctctctgaccttttattctcttgcatatgcatgttcctgagaacagcacttagtcctctttcactacccaatctgtactccctcgcaatctcatccttcatctctcctgattttcaaacatcctagactggatatttcagacacttaaaattcaacagatctcaagagaatatatttctcatgagcatcctccatggatctccctgacccggatctgtctgcctgttctaagtccagggctctttgcattatcctatgggatgaaaggcaccatcatggtctgcctggctgtggaaagcaagagggactcctgggctcatctgccctccataggcaggaacccaaatggggaaagaggaagggaactgtctaaaaaagttgctttctcaggttgtgtggagagacaggactcagtgaggataggcccctacaggcctatcaaccagccactctgtggctaaaagttaattgtccaataaaatttagctatcccaggataaggcatttctactttatacgattattctgttttaaaatatatttgctttgagagtaattccccaaatagaattcctattttctacagccttgctcttcttgttttatccttatcaatagtgccatcatccactgccctgacacctctgattccttcctttccctccatttcacaaaatctatcaattctacttagtgactctatcccactggtgttgaattctcccttttttttttaaacagcagaaacagtttattaaaatagaaatcttatgtagaacctttatgcataaaaaagattcaagctgcttcacttgaaaacaggaagcagcaccaaatccccccatactcaactccaacccttgcttgtctcaaggcacctacatagaaacccagagtgtctcagaagaacagctggagcgctacagcctgctctcttctgctgtccccactgcccccggctaggatcacctcctacaagattcctgcacagcctactgacttttctccctgctcaccctcttccatccctctaacccagctcctagcatctagtgcttcttggacttttgtaccaagtagccccaacagtaggagagaggtctggggataagtgaaatgaatatgactatttgaattaccactatcagttttagtatcttgaggcttcaagaactgctctacctagcaccaccaccttccctaaggacataagtacgtactctagactgaaaggttctactatacaccatctaatctgatcattccccggttcctcattacttacgagagaaaaatccaaatttcttattttagcattcaaggcactttacatgcagggctctacttccaagctggggcatgtggttccagagaaagagaggatacctcaggacagtatgatacatcttacctaatggtaagtaatttaaaatattaaatttatattaaataggtaatatggtgttaaaatgcaacacctacgtgaatttgtaaggcaaaacagtacttcaaagaaatgtatatgcagtgagacatttctagctttatttccagatccctttcaacccaggtaccatttaatctctgtaattaggtgtactctggtggaacactcaccattttttagatgaggaaacagggtcagaaaggtcaagtgacctatccaaggtcacacaactagcaagcagttaagctagacttttactgtaggcagtctgcctccagtcccgctcctaaccactgtactgtattatctcctcaaatgcattagaatcttcacttccataaagaaatatgctctttgtttttttcttttggaacacaaggtttagtccatcactcactcacttttccacttttgataagatgtaaatattgagaactatttctcttctccagtagaagaagagcaacaggccatgtgtgatggtaaatggcagctgacacttgcgacagtatcaagaaggcactaaggaatggtgagaaggatgacttgccctttctaaagtggcatctcagcttgagtctgcagaatgccttgcaaatccagctcagtactgctagataatccatattgacaagagaagctaaagattcagattttctatgtgaagtttcctggttttaaaatgttagcaacaaattccaaatttttacagaacactgtacaggccagaaagaacaatctgtgtgctaccagtttacaattagctatgcttcttcctcctcagacctggcatgccctttccacccccttgcctttgctcttagtaccccgtgtacactccaacctcttccacctacaaatttctaaatgcacagttcaaatgttagttcttcagattcctgtctctgtaataacacttgcccctttgtataacagttctcatgtatatcttcctattagaccatgagctcctgtggtagaaattgtgtattcattactgtatccctagtgtgcagtaaaggatcacagtagatatctgctgaaccaagctgtaatgcttctgcaaaacaggacttatcagggagtcctctgcagggagtgtgccctgcatccatcctgtatccatccataaccccagcctccctcaccttaaggatgtccttaatgatcttcttttcatcatggaatcgtgccttcaactcctccacatagaacttgaataagtccagaggggtggagcctgtaaggagggagggaggggggcctggcgggcggcagcttcccaaggcctgggggctgggccgaggacaggagccggtagtagggggtgcagagaggctggcagggcaggaagccaggccagagaagggggagcctggctgccttacccggctggcccagcatgttggcaaagcggacatcagtgctgactgctggatatagctccatccaggtggacatagagtgcagctgccctgtctcatgcagctcgtccaggaaggtctgagcagggagaggccagttatagggagagtgagacagggaggcagagccacagactgagggggaagagagggaatggcagaggaagaggcagggacaatcaagattgaggaaatgcaggcaagagaggcagagatgaagagatgcagatggaaggctgagaacaatgcaaaaagagagaaagtaaatacacagagagggacagaacaaaaaggtgagaacaagccagtcccgggatgcaaagaaacagaaacctgcctgcagtaacccctagcactaccaccaccactgccacccccaagctgagggaataaactctgcctgtcgggtgccccaccaagggaaataaacatggcctagctgccaagtcatgcctgtagggtgctctctactggcagtttctgggtggtgcatacatctagtctccctagaagagcacagtccagaattgaggaggtacagcagaaacagactgcaggcagagagaggtctcatagagcttggacagggctaggcacagaaagaacaggcagcgtatccagaagggggcagggaatgggtgaagaggttgtgctctagggcagagctgagctctgatctagaaaggacagcaaagatacctggaaggcctcccgattcttgcgttgttggcgtcgctcccgaagccgggcccgctcccgttcctcctcctcttccctctccaaagctcggatgtgctcctcaaaacagatcagtgcatcttccttgtccatgtctaaagacaggcaggaggttccgcgggcattgtcccagcaggataccctctcagaccccagcacccctaatgtttcaacgatgctgtcctacaggtgctagggatacccagggtggtgggggaagggcctggagggggctctgtgggagcagccactgcaatggtagttcttaagaggggatcattaattgtataagaataaataagcaagtattca

SEQ ID NO: 7611 - DNA, 720 bp, Homo sapiens
  ENST00000550668
attacttacgagagaaaaatccaaatttcttattttagcattcaaggcactttacatgcagggctctacttccaagctggggcatgtggttccagagaaagagaggatacctcaggacagtatgatacatcttacctaatgtagaagaagagcaacaggccatgtgtgatggtaaatggcagctgacacttgcgacagtatcaagaaggcactaaggaatggtgagaaggatgacttgccctttctaaagtggcatctcagcttgagtctgcagaatgccttgcaaatccagctcagtactgctagataatccatattgacaagagaagctaaagattcagattttctatgtgaagtttcctggttttaaaatgttagcaacaaattccaaatttttacagaacactgtacaggccagaaagaacaatctgtgtgctaccagtttacaattagctatgcttcttcctcctcagacctggcatgccctttccacccccttgcctttgctcttagtaccccgtgtacactccaacctcttccacctacaaatttctaaatgcacagttcaaatgttagttcttcagattcctgtctctgtaataacacttgcccctttgtataacagttctcatgtatatcttcctattagaccatgagctcctgtggtagaaattgtgtattcattactgtatccctagtgtgcagtaaaggatcacagta

SEQ ID NO: 7612 - DNA, 4120 bp, Homo sapiens
  ENST00000550488
ggaggtggggggccgaggcccctgagggggccccgccgcgatgggcaacctggagagcgccgagggggtcccgggagagcccccctctgtcccgttgttgctgccgcccggcaagatgccgatgcctgagccctgtgagctggaggaaaggttcgccctggtgctgagctccatgaacctgcctccagacaaggcccggctcctgcggcagtatgacaatgagaagaaatgggatctgatctgtgaccaggaacgattccaggtgaagaatcctccccacacttacattcagaaactccagagcttcttggaccccagtgtaactcggaagaagttcaggaggagggtgcaggagtcaaccaaagtactaagggagctggagatctctcttcgcaccaaccacattgggtgggtgcgggaatttctgaatgatgaaaacaaaggcctggatgtactggtggattacctgtcctttgcccagtgttctgtcatgtttgactttgagggtctggaaagtggtgacgatggtgcatttgacaaactccggtcctggagcaggtcaatcgaggacctgcagccacccagcgccctgtcggcccccttcaccaacagcctcgctcgctctgcgcgccagtctgtgctccggtatagcactctccctgggcgcagggccctgaagaactcccgcctagtgagccagaaggatgacgtccacgtctgtatcctttgtctcagagccatcatgaactatcagtacggattcaacctggtcatgtcccacccccatgctgtcaatgagattgcacttagcctcaataacaagaatccaaggaccaaagcccttgtcttagagcttctggcagctgtgtgtttggtgcgaggaggtcacgaaatcatccttgctgcctttgacaatttcaaagaggtatgcaaggagctgcaccgctttgagaagctgatggagtatttccggaatgaggacagcaatattgacttcatggtggcctgcatgcagttcatcaacatcgtggtgcactcggtggaggacatgaacttccgggtccacctgcagtatgagtttaccaagctggggctagaggagttcctgcagaagtcaaggcacacagagagcgagaagctgcaggtgcagattcaggcatatctggacaacgtgtttgatgtcgggggtttgttggaggatgctgagaccaagaatgtagccctggagaaggtggaggagttggaggagcatgtgtcccatctcacagagaagcttctggacctagagaatgaaaacatgatgcgggtggcagaactagagaagcagctgctacagcgggagaaggaactagagagcatcaaggagacatatgagaacacaagccaccaggtgcacaccctgcggaggctcattaaagagaaggaggaggcctttcagcgtcgatgtcatttggagccaaatgtccggggcctggagtctgtggacagtgaggccctggccagagtaggccctgcagagctgagtgagggcatgccaccctccgacctggaccttctggctccagccccaccccctgaggaggtcctgcctcttcctccaccaccagctccgcccttgccccctccacctcccccattaccagacaagtgtcccccagccccacctctccctggtgctgcaccctctgtggtgttgacagtgggcctgtcagccattcgaattaagaaacctatcaagaccaagttccggctgcctgtcttcaactggacagcactgaaacccaaccagatcagtggcactgtcttcagcgaacttgatgatgagaagatcttggaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacagtgctgaagagtgtccctttcacggcccgtactgccaagcggggctcacgcttcttctgtgatgcagcccaccatgatgagtcaaactgttagcccccaaggttggggcccgacaggcctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattggccaagggctcaggagagggctgtgttgctctctcaaccatgtccgccccagctcttgaggctggatctttctacttgtgccactatgggcactaggtctgtaggtccctggtgcttccagtactgcactttgcccccaaggtctttgacttcatttcctgaagggtcaccaagggtcagctcagggctaggaaaaaccatttccagccttagcctaaacagggcacatagatctctcccactagagcccagagggatgagaggagagagcaactgttctttctttttttttcccttcctttttgcaggcccatggtcagctctggtctagatgtatctaggcttagggagccctgggaccctgccagtctcagttcatctcttaccaggagcaaggccctctgaagcatgggccgtgccagctgtgccctagtgataagggtaagaggagagatgtcaggctcactgcccttatttctctgcccatttcattctaggctcacactgtccttgtcaaggtgggcagaagagcagaggtcttctctgcaccaaccactctctgcagatggctggagaaagggtgtgccaactcttcaccttctttcctcagctacggtttttttttttttttttttttttttggcaggggacaaggagcatggtggtcttggctatttgcttaccttcccgtttctcctctgcccctggaagggaatgtgggggcccacttttttgtacatgtaccacctccctttcctcttactgtacataaacctcagactctccccctctcaacaaaggcttgatgcaccagg

SEQ ID NO: 7613 - DNA, 2650 bp, Homo sapiens
  ENST00000549137
tttcccttaatggtgctgtctgcctgccaggagacatatgagaacacaagccaccaggtgcacaccctgcggaggctcattaaagagaaggaggaggcctttcagcgtcgatgtcatttggagccaaatgtccggggcctggagtctgtggacagtgaggccctggccagagtaggccctgcagagctgagtgagggcatgccaccctccgacctggaccttctggctccagccccaccccctgaggaggtcctgcctcttcctccaccaccagctccgcccttgccccctccacctcccccattaccagacaagtgtcccccagccccacctctccctggtgctgcaccctctgtggtgttgacagtgggcctgtcagccattcgaattaagaaacctatcaagaccaagttccggctgcctgtcttcaactggacagcactgaaacccaaccagatcagtggcactgtcttcagcgaacttgatgatgagaagatcttggaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacaggcctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattggccaagggctcaggagagggctgtgttgctctctcaaccatgtccgccccagctcttgaggctggatctttctacttgtgccactatgggcactaggtctgtaggtccctggtgcttccagtactgcactttgcccccaaggtctttgacttcatttcctgaagggtcaccaagggtcagctcagggctaggaaaaaccatttccagccttagcctaaacagggcacatagatctctcccactagagcccagagggatgagaggagagagcaactgttctttctttttttttcccttcctttttgcaggcccatggtcagctctggtctagatgtatctaggcttagggagccctgggaccctgccagtctcagttcatctcttaccaggagcaaggccctctgaagcatgggccgtgccagctgtgccctagtgataagggtaagaggagagatgtcaggctcactgcccttatttctctgcccatttcattctaggctcacactgtccttgtcaaggtgggcagaagagcagaggtcttctctgcaccaaccactctctgcagatggctggagaaagggtgtgccaactcttcaccttctttcctcagctacggtttttttttttttttttttttttttggcaggggacaaggagcatggtggtcttggctatttgcttaccttcccgtttctcctctgcccctggaagggaatgtgggggcccacttttttgtacatgtaccacctccctttcctcttactgtacataaacctcagactctccccctctc

SEQ ID NO: 7614 - DNA, 4006 bp, Homo sapiens
  ENST00000352151
cttgcttcggtgcggctgtccgctacgctgcctccgccctcgccgcgcgcccccgccagcgggactccagggaacccccggcgccctcgacggggccgaggagtcgggactcggggagccggcgctgagggaggagcctggtcggagccgcggagccgaaagctccggagcgtggaggtggggggccgaggcccctgagggggccccgccgcgatgggcaacctggagagcgccgagggggtcccgggagagcccccctctgtcccgttgttgctgccgcccggcaagatgccgatgcctgagccctgtgagctggaggaaaggttcgccctggtgctgagctccatgaacctgcctccagacaaggcccggctcctgcggcagtatgacaatgagaagaaatgggatctgatctgtgaccaggaacgattccaggtgaagaatcctccccacacttacattcagaaactccagagcttcttggaccccagtgtaactcggaagaagttcaggaggagggtgcaggagtcaaccaaagtactaagggagctggagatctctcttcgcaccaaccacattgggtgggtgcgggaatttctgaatgatgaaaacaaaggcctggatgtactggtggattacctgtcctttgcccagtgttctgtcatgtatagcactctccctgggcgcagggccctgaagaactcccgcctagtgagccagaaggatgacgtccacgtctgtatcctttgtctcagagccatcatgaactatcagtacggattcaacctggtcatgtcccacccccatgctgtcaatgagattgcacttagcctcaataacaagaatccaaggaccaaagcccttgtcttagagcttctggcagctgtgtgtttggtgcgaggaggtcacgaaatcatccttgctgcctttgacaatttcaaagaggtatgcaaggagctgcaccgctttgagaagctgatggagtatttccggaatgaggacagcaatattgacttcatggtggcctgcatgcagttcatcaacatcgtggtgcactcggtggaggacatgaacttccgggtccacctgcagtatgagtttaccaagctggggctagaggagttcctgcagaagtcaaggcacacagagagcgagaagctgcaggtgcagattcaggcatatctggacaacgtgtttgatgtcgggggtttgttggaggatgctgagaccaagaatgtagccctggagaaggtggaggagttggaggagcatgtgtcccatctcacagagaagcttctggacctagagaatgaaaacatgatgcgggtggcagaactagagaagcagctgctacagcgggagaaggaactagagagcatcaaggagacatatgagaacacaagccaccaggtgcacaccctgcggaggctcattaaagagaaggaggaggcctttcagcgtcgatgtcatttggagccaaatgtccggggcctggagtctgtggacagtgaggccctggccagagtaggccctgcagagctgagtgagggcatgccaccctccgacctggaccttctggctccagccccaccccctgaggaggtcctgcctcttcctccaccaccagctccgcccttgccccctccacctcccccattaccagacaagtgtcccccagccccacctctccctggtgctgcaccctctgtggtgttgacagtgggcctgtcagccattcgaattaagaaacctatcaagaccaagttccggctgcctgtcttcaactggacagcactgaaacccaaccagatcagtggcactgtcttcagcgaacttgatgatgagaagatcttggaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacaggcctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattggccaagggctcaggagagggctgtgttgctctctcaaccatgtccgccccagctcttgaggctggatctttctacttgtgccactatgggcactaggtctgtaggtccctggtgcttccagtactgcactttgcccccaaggtctttgacttcatttcctgaagggtcaccaagggtcagctcagggctaggaaaaaccatttccagccttagcctaaacagggcacatagatctctcccactagagcccagagggatgagaggagagagcaactgttctttctttttttttcccttcctttttgcaggcccatggtcagctctggtctagatgtatctaggcttagggagccctgggaccctgccagtctcagttcatctcttaccaggagcaaggccctctgaagcatgggccgtgccagctgtgccctagtgataagggtaagaggagagatgtcaggctcactgcccttatttctctgcccatttcattctaggctcacactgtccttgtcaaggtgggcagaagagcagaggtcttctctgcaccaaccactctctgcagatggctggagaaagggtgtgccaactcttcaccttctttcctcagctacggtttttttttttttttttttttttttggcaggggacaaggagcatggtggtcttggctatttgcttaccttcccgtttctcctctgcccctggaagggaatgtgggggcccacttttttgtacatgtaccacctccctttcctcttactgtacataaacctcagactctccccctctc

SEQ ID NO: 7615 - DNA, 557 bp, Homo sapiens
  ENST00000550970
agctccatgaacctgcctccagacaaggcccggctcctgcggcagtatgacaatgagaagaaatgggatctgatctgtgaccaggaacgattccaggtgaagaatcctccccacacttacattcagaaactccagagcttcttggaccccagtgtaactcggaagaagttcaggaggagggtgcaggagtcaaccaaagtactaagggagctggagatctctcttcgcaccaaccacattgggtgggtgcgggaatttctgaatgatgaaaacaaaggcctggatgtactggtggattacctgtcctttgcccagtgttctgtcatgtgagtaccaccccggggctgaagttggggaccagttgggggaggacatagttccattctactttgataaggaagggtgagagttcaacaatgaagatggaaatgggaatcctggacaggaaggagtagcccaagcagtggtgtggaagtaggcaggcaagcccggagatgtctggggatcagtgaagaatggcacttggctggagtagaagataagatgcattttggaga

SEQ ID NO: 7616 - DNA, 547 bp, Homo sapiens
  ENST00000550424
actggaagaagatggcggctagacaacaaatttccaccgcaaatgtcaacgacccagccgccgactgagcccagaacagcgttcttctcccgcctctccattttcacacgcagccagatggttaagcttctctcctcccaaacgttttttcccctgcctctgtcgggtaagggcttcctcatccctcaatgcctggtccaactatgatctccctcaccccgactcttaacagacccacttaccacaagccatcatcatagctatatataaagatctgggggatgagttttctaggaagagaacaacttttgcaaagccctggggtggaaaagaactttgcacatttgaggaactgcaagaaggccagactggtctacaaggatgctgaggagagtccgagaaggtataggaaagagctccatgaacctgcctccagacaaggcccggctcctgcggcagtatgacaatgagaagaaatgggatctgatctgtgaccaggaacgattccaggtgaagaatcctccccacacttacattcagaaactcc

SEQ ID NO: 7617 - DNA, 2087 bp, Homo sapiens
  ENST00000367755
gtaggctcactagaacattttctctttcaaactgcccagacggttggacaggacgtagacacacagaagaaaagaagacaaagaacgggtaggaaaattaaaaaggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataa

SEQ ID NO: 7618 - DNA, 828 bp, Homo sapiens
  ENST00000530212
tttcaaactgcccagacggttggacaggacgtagacacacagaagaaaagaagacaaagaacgggtaggaaaattaaaaaggttaccatggggaagaaagtggccatcattggagctggtgtgagtggcttggcctccatcaggagctgtctggaagaggggctggagcccacctgctttgagaagagcaatgacattgggggcctgtggaaattttcaacagagtttctctcttgttgcccaggctggagtgcaatggcacaatctgagctcactacaacctccacctcctgggatcaagggattctcctgcctcagcctcccgaatagttgggattacaggtgtgtgccatcacgccccgctaatttttgtatttttagtagagatggggtttcgccatgttggccaggctggtctcgaactcctgacatcaggtgatacacccgcctcggcctcccaaagtgctggaattataggcatgagccaccactcctggccagccatatcttatacacagtgatcttaaccaaagcctcatactcaaatttagtttgcaagacgttgctgaagatagaacgcactgctgatatggctattgagaggaacacagccaaagacagctaatttgtcttttcttgctgctcgaggaagactttaaaatttgaacctggcagcataggttgataaaactgaactgcaacatgtgctacccttcaagaaaaagaaaggatagcccagagggtagagcctcaggccctgagggcagaggcctgagccaaagccttcaagcctgaaggaatttgtcctactggatttcaaaattgctt

SEQ ID NO: 7619 - DNA, 1142 bp, Homo sapiens
  ENST00000534514
aaactgcccagacggttggacaggacgtagacacacagaagaaaagaagacaaagaacgggtaggaaaattaaaaaggttaccatggggaagaaagtggccatcattggagctggtgtgagtggcttggcctccatcaggagctgtctggaagaggggctggagcccacctgctttgagaagagcaatgacattgggggcctgtggaaattttcaagtttctctcttgttgcccaggctggagtgcaatggcacaatctgagctcactacaacctccacctcctgggatcaagggattctcctgcctcagcctcccgaatagttgggattacaggtgtgtgccatcacgccccgctaatttttgtatttttagtagagatggggtttcgccatgttggccaggctggtctcgaactcctgacatcaggtgatacacccgcctcggcctcccaaagtgctggaattataggcatgagccaccactcctggccagccatatcttatacacagtgatcttaaccaaagcctcatactcaaatttagtttgcaagacgttgctgaagatagaacgcactgctgatatggctattgagaggaacacagccaaagacagctaatttgtcttttcttgctgctcgaggaagactttaaaatttgaacctggcagcataggttgataaaactgaactgcaacatgtgctacccttcaagaaaaagaaaggatagcccagagggtagagcctcaggccctgagggcagaggcctgagccaaagccttcaagcctgaaggaatttgtcctactggatttcaaaattgcttgggattagtgattcttttctttcctcctttttcctccccggttaaatgggaatgtcgataacggttacccatgcttgtcccaccattgtattttggaagaagataacttgttttctagtttcacaggttcacagatagaaattttgcctcatcctggtccatatccagagtctcatttatacctgatttagataatttatatgatgatgagattttggacttttgaattgaaaatatataaatgagagttgagacttgatttcatgctgctatgggttgagactttgaggatgttgggattgggttaatgtattttgcagat

SEQ ID NO: 7620 - DNA, 582 bp, Homo sapiens
  ENST00000472784
cggttggacaggacgtagacacacagaagaaaagaagacaaagaacgggtaggaaaattaaaaaggttaccatggggaagaaagtggccatcattggagctggtgtgagtggcttggcctccatcaggagctgtctggaagaggggctggagcccacctgctttgagaagagcaatgacattgggggcctgtggaaattttcaaggagccatgagtgaaggcgtacaagaggggtcttgccactgaaaaaaataagaaatgccagcatccaccagaagccagaagcggcaaggaatggattctctcctggagcctctgaaaatgaacatggaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttacc

SEQ ID NO: 7621 - DNA, 723 bp, Homo sapiens
  ENST00000479749
gttggacaggacgtagacacacagaagaaaagaagacaaagaacgggtaggaaaattaaaaaggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtc

SEQ ID NO: 7622 - DNA, 713 bp, Homo sapiens
  ENST00000478457
agaggatggcctgtaataggctgaacaatttaacaatgcccctcctcaaagatatcacatccaaattcctggaacctgtaaatgttatcttacttacaagagaaaagggtatttgcaaatataattaagttaaaaatcttaagatggagagatttttctgcattatgtgggtgagccccaaacgctataatgaatgcatcgttaaaagagagaggcagagggagatttaacacaaagagaagagagaaggtgatgtgatgacctcaacagaaagagagaaatttgaagatgctatgctctatctttgatgatggccagaggagccatgagtgaaggcgtacaagaggggtcttgccactgaaaaaaataagaaatgccagcatccaccagaagccagaagcggcaaggaatggattctctcctggagcctctgaaaatgaacatggaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggta

SEQ ID NO: 7623 - DNA, 946 bp, Homo sapiens
  ENST00000421757
gcggcggcggcggctggaggaggagagcggcggcggcgggagcagcgaagggggcggcagggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaagatgaagtggtgaagagagcctgcgattgaagattttttcatctcagctttttcccccttaccttgttctctctcatgtttcatgatctgtgtcatagatatttcttcattacgagcacttcgcggtgtggcttttcaatgtctgaagtggattaagtggcccacagtcagttctgtgacttgagtttcaaaagtaaaattaccatcaacaatgtgattcaattttattttctatactagctaaaagcaaggaactatattattaacaatcttggctttactgtagtttaaggcaggtgatgatgatgcttattagtccacctgaaagagtccttccaggtttttggaagctttattcctgcttattaccttgcccttgagaagtccttcatggaaagtggaaacactgggttgacttcttttccccatatcctagttgaaagggacagcttatatgtatgttagactgtccaaaagtgtttgtagaacctcattttaaaaaatcaactgtattgtactttttaaaaaatgggatcttaaactctttattaaaaataataaatggaaatgtgttaagcaaaaacatta

SEQ ID NO: 7624 - DNA, 5083 bp, Homo sapiens
  ENST00000415807
gcggcggcggcggctggaggaggagagcggcggcggcgggagcagcgaagggggcggcagggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaacctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtataaattcaggctgactgcttctaatacggaaggaaaaagctgtccaagcgaagttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaagcgaatcagtgggaagtggcctacagtgggtcggctaccgaatacaccttcacccacttgaaaccaggcactttgtacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggatttttttttttaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcatatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctgtataagaaatcaagtaaccagaatgcacctataaattatggagcattgtagattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggg

SEQ ID NO: 7625 - DNA, 2916 bp, Homo sapiens
  ENST00000469491
ggcggcgggagcagcgaagggggcggcagggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaacctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtataaattcaggctgactgcttctaatacggaaggaaaaagctgtccaagcgaagttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaaggtgaagtttttggcaattgttttattcaaatccaatagcaagctctgttttctaatatagtaaatgtctttatagtaatagtgagtaatcattaattctaaagatagaattattattacaataaacaaactttagtcacatattggcagtttttctatttcaaacacagcaccagagatcagagtctacttgaaacttacatttgtgttatttaacaatttttctgtatctttttcattggtgttttgttttgtttatcttttgtttttgtttctttggtttggtttgtttttgttttgttttttgagatacgatctctgtcacacaggctggagggcagtggcacaaacatggcccattgcagtctcaaactcctgggcttaagtgactcttctgccacagaagatgaggaagaatacatttttcatagtgatggggtctcactatgttatctaggctggtctcaaactcctggcctcaagcaaccctccaccttggcctcccaaagtgctgggactatagacatgaatcaccacactcagcttccatgtctttttatgaactagggttcctaattaatcagataaatttggtattttcatctcctaacttgccatatgttttctggaaattcttataagcagccgagagtggtggctcacgctgtaatcccagcactttgggaggctgaggtgggtggtcaagagatcaagaccatcctggccaacatggtgaaaccccgtctctactaaaaatacaaaaattagctgggtgtggtggcaggcacctgtagtcccagctacttgggaggctgaggcagaagaattgcttgaacccagcaggcggaggttgcagtgagctgagattgcaccactgcactccagcctggtgacagagtgagactctgtctcaaaaaaaaaaaa

SEQ ID NO: 7626 - DNA, 7904 bp, Homo sapiens
  ENST00000336824
aagctcgggcgggggagcggggcgcggcgggaaggagcgggcgacccggtgtgtgggccagcggagctccggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaacctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtataaattcaggctgactgcttctaatacggaaggaaaaagctgtccaagcgaagttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaagcgaatcagtgggaagtggcctacagtgggtcggctaccgaatacaccttcacccacttgaaaccaggcactttgtacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggatttttttttttaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcatatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctgtataagaaatcaagtaaccagaatgcacctataaattatggagcattgtagattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgtttgtaagtgctttgagatctttgaccaacaggtgctattggagtgcaaagtgttactcttacgtgtttattttgagtcatgagataatcaattttaacccaaagtcattggattatttatatgaagtccataatgttcgagtacctcagggacatttaagagttggaggtgcaaatatattccaaaagggtgcaacagacacagtgtatccccctgcttctgtttttgtatatttttgctacttggtttttcttgatcatagctattttgtgcttgatctttattgtctaagatgcagtatcctgtactagcttataatattcccataccaaagtcatggggaaacaaacattattttgtttttggtttatttatactatattctgcatacagtactttaaatgccaattacagtgcaatctttatttattgtaaaattttttaagtgtacttatgtactaattttcccttgtagcatgttatatttttgtgttttatacttttgtaattttaggtcagtcttgttccttggcaacatctgtagtattattaatcttctgacattttcttatgtttttaaaaagataagagcatctagtgcattaaatgccaaaaaaaaaatacattatcagtgattgaaacgtttacatgtacccaaaaaccataatcatctcttggaagaaaatgctgagatcaatgaattattctgtgtgcctatattgacgtagtgagtactagagagttctgtattttattattgactataataattagtttaattagctttgcaaactgatggcatcaaggtaaatatatttttgccaaagttctggccttccaaaactcacccccttatttaaatgtgtgctatgacccactatgaccacagcatctgcattttctaaaaaattccatgcaggtgttttggggagaggtattttttaagcaatgaaaattcaactgagtacaaagccccctcttggggggttggggaagtctcttttttgaaacacttcagaactgctgctataaagaaattctctaattggttgaattttttttttaagtaaatagtactttaggccaaaatttatatgaatatttgatcttcttgagattttcatactatcatttaaccaccaggaagctgaagtgtgtgaagtacaaagctgacagcactttattttattgctctccattatttggtattcattatattccttcagtcagaaaattattactctctatggcactgttttttatcacaaatatgtatatgtgatattgatatataactatatatattgccatcacacacgaacaataaaataaagtgttctattaacctgatctctttgcccttttgctatgtgaggagtgaatgagtggccttctgatgctctgactcttctctgtatgtcaaactcatccctggcacaagaaattccagtcatgtgaagcaaactgccctttgtcctcaaagaaattgttgaaaaagaaaactttttaaagagattttttgcatattctctgccttgttcttatcaacttgaaatgttggcattttctaaccttgttttgttggctacaataattcagtattcatgtcaaaattgagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtatagattttgcaaatattatgctatatgtaatacctaactgtatctgtagtgtatatgtaatatatttatgcccaataaatgttttaattctttctgacttaaatagggtttttctgccatgactaggattgcttttgttgttgttgttgttgtttctttctttttttttttttttgagacggagtcttgctctgtcgccaggctggagtgcagtggcgcgatctcagctcactgcaacctccagctcccaggttcaagtgattcccctgcctcagcctcccaagtagctggggattacaggcactcgccaccatgcccggataattttttttttttttttgagttggagtcttgctctgtcgcccaggctggagtgcagtgacccaatctcggctcactgcaagctccacctcccgggttcatgccattctcctgcctcagcctcccaagtagctgggactacaggtgcccgccaccacgcccggctaatttttttaattttagtagagtcggggtttcaccatgttggccaagatggtctcgatctgacctcgtgatctgcccgcctcggcctcccaaagtgctgggattacaggtgtgagcccccgcacccagccttattcttcccttttaaatacttaaagcacattcagattagttgaaaattcacgtgtttttggaggccaggcaggtggccttctgcagagacagcagcagctcagctcttgctgaccaaggccttggaggactgtgagccacaatcacatatgtccatgtttcaaaagaagctaaatatccagatttcctccatgggccaactaaaaggtgattgtggactatacaggctgccagtttaatcctttatcagagtctctgtggataatgtaccttgttgcctaatactttatctgtctaccaaaactcagtccagatctccctctgttcacctggcacactgggtgcttcctctcccctgacgaactctatagagtgttcatgtcctttcctgcaggtctcattcaacaacaacaacaacaacagcaataaaacacagtgttcctgcta

SEQ ID NO: 7627 - DNA, 408 bp, Homo sapiens
  ENST00000423424
agctcgggcgggggagcggggcgcggcgggaaggagcgggcgacccggtgtgtgggccagcggagctccggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaagatgaagtggtgaagagagcctgcgattgaagattttttcatctcagctttttcccccttaccttgttctctctcatgtttcatgatctgtgtcatagatatttcttcattacgagcacttcgc

SEQ ID NO: 7628 - DNA, 3684 bp, Homo sapiens
  ENST00000416957
agtgtctaccaccaaactcctaaggctggatggtggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaacctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtataaattcaggctgactgcttctaatacggaaggaaaaagctgtccaagcgaagttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaagcgaatcagtgggaagtggcctacagtgggtcggctaccgaatacaccttcacccacttgaaaccaggcactttgtacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaa

SEQ ID NO: 7629 - DNA, 554 bp, Homo sapiens
  ENST00000478016
gagcagacactggaatgtgaatgcattgggaggtgagcccttaaggagagcccaaatgtttaccaaagagaaaatctggtcagaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtaatccatttgatggacttctctactcactatggacactgtcgttgctccaacagaatatatgttgaggcttcaaagccatattccaggagttaatttgggtaccgtagtgctaggtttgccatcattttgtggcaccacatggcgtttcttgtgtcttgccacttgacgtaccagagaaccagagaaaaggagacacagaaggcctactagactgtcctctgccaagtggggtttttatatttgattgtttggttgtgatttctttatggagtctcctgcttcagacatttccttccacctgtaatacaacttt

SEQ ID NO: 7630 - DNA, 678 bp, Homo sapiens
  ENST00000443501
agcagacactggaatgtgaatgcattgggaggtgagcccttaaggagagcccaaatgtttaccaaagagaaaatctggtcagaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaacctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcgga

SEQ ID NO: 7631 - DNA, 682 bp, Homo sapiens
  ENST00000476794
gcctacagaagagagaagccatgagagacagttgagctcatattaatgagcactcaccatgccaggcttggttctgggtgctgagaagacagcagcaaacagaactgacaatgaagaaagagttaaacaaataaacatataccagaggaggtgatggcgatcaagaaaatactagatgaagtggtgaagagagcctgcgattgaagattttttcatctcagctttttcccccttaccttgttctctctcatgtttcatgatctgtgtcatagatatttcttcattacgagcacttcgcggtgtggcttttcaatgtctgaagtggattaagtggcccacagtcagttctgtgacttgagtttcaaaagtaaaattaccatcaacaatgtgattcaattttattttctatactagctaaaagcaaggaactatattattaacaatcttggctttactgtagtttaaggcaggtgatgatgatgcttattagtccacctgaaagagtccttccaggtttttggaagctttattcctgcttattaccttgcccttgagaagtccttcatggaaagtggaaacactgggttgacttcttttccccatatcctagttgaaagggacagcttatatgtatgttagactgtccaaaagtgtttgtagaacctcattttaaaaaatcaac

SEQ ID NO: 7632 - DNA, 666 bp, Homo sapiens
  ENST00000483344
ttctctccagtctgtgacctcttattactgtttcttttgcctttttatccagctcttaactcttagcctttttccagataaagtcaaccagagagtagctcatggggttttagaacatatatttggagatcgttctggggttaaggtttattttcttacttagaataatctcttctagtcagtagatcctgcctatcttgaaatggagctgggtggcacacactgagacaaatacctgttgggatgactgtcccctgttaatgctaaccataggtcaggacaagaccaacagataagagcaagagcatgatactcactccgtaagaaattctgttcatctacagaaagccttagggtgaaacaaagataagaatcctggtcttctatgatgagtcactgccactgactgtgtctgttttgttttcagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgaggtaagcttattttcatattcacccatctaaaacaccatttcaaaaa

SEQ ID NO: 7633 - DNA, 2600 bp, Homo sapiens
  ENST00000494000
caggtatgacgtttccttgtcctcttgcccttcagcctttggatggtgatcctgagccttcttttacatagctggaaggcatgaggaagcctgctgcctccacactaaatcaactggaggttttccaagagggaatcctaatcagaggagagaaggcctcctttaagctggtgaatgtcactatggcctctgcagtcttgcaagctgtattgcgaaggccccactaggggtctctaagaaccaaggtgaaggtagcagtacagatcttgaaaggaattcctcttggagctttaattttttagatcacatgcctttttcttttatcactttagcaagctcttcattcacttgccttttttcaattatgtgagtgtttcctggtacaaagaaagagatgctgggccagccattgttgtcaagcccagggcagatacggaattggagaaaacctggactgtcttagaggcctctgcaggcctctaggctgtatgagaaaggcgagaacgggtgtactgtaaggtatcaattgattaaagaggctttgaaaaggccatgtttcagttgcacttggggggtaactcttcattaagggaaaaatctttttctttcatcactgcttgttgaaatcttcttaaaggttttgcacatcggtggtccccaaccctctttccaacctaaagaacctctttttaacatcacaaagttttacagacctgcctccaccaccatggtagccattacagcttcagagttcactggttgaaaaaataccgacacaaagccctttatggctcaagaatttttaaatgaattggaagcatccacaaacttttgaaaaacagcactgtatatattgtaaaacattatttcatcaacaaatatttgttgctcacattgatttgaaggctccttgacccgtaacttgataaacattgccttgtgctataccttctttccagtgcttttgaggggggaaaatgaattcttaagtacaattgtcctttggtttccacaggggattggtttcaggacttcccccacctccctgccatgaataccaaaatctatggatgccccagtcactgatataaaatggcatagtctttgcatataacctacacacatccttctctccttaaatcttctctaacttgcttataatatccaatataatgcccacacgtcacttcattcacgtggactcaagatgcagaacccaaggatacagaaggccaactgtatattgtcctgtgacttggtgtgtgtgtctagtagaagatcatggggtggggggatggggaagctgaaggtggttatagggaatatcacacacagcatccttacctggctttgcttactctacctgctaggctgagttgggtagtgtgcaggctgagccttcctcttttaaaatgccaagcctcttcacatgcttctaactgtgtgcctcactttctttctctacagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtataaattcaggctgactgcttctaatacggaaggaaaaagctgtccaagcgaagttcttgtttgtacgacgagtcctgacaggcctggacctcctaccagaccgcttgtcaaaggcccagttacatctcatggctttagtgtcaaatggggtatgttttgctgctgctgctactgttttttttttttttttcttttgatagatttttaaaaaatgattcattttagtagtgacaagccaaaaaaattgtggatggtatttgcagaagttttctgcattcggaatatatgtgtgagaaacatcctgagaattctacaaattggaatggacaatttcattaaaatgtaatcgtaatggacaattaaattttagtggaaattaaaatggatgatttttaagagtatctcatttactctatgattttcctgtttacatatttttttctcctatatttttaaggcatggatttgaatgtagtaatctctgcatgcatcgttcattcttcaatagttcatccttaaaaaattagcaatacttaatagaaaaattttgatttataaagttaatattgaaaataaatttcaaaatttaggtttgttaagtaaactttagcatacagaacatttaagttgcaatgaattagggatagttttgtttccattggtgtttgttgtataaagtcttgaactttgggaaattttaacattaaagttcataaggagtttgaggttgtctggcaaaaggatattgtgcctcacctctgttgtgtgaattatttcaataaaatgaatacaattagaaggttgacaattaatatgtaaaagtgttatgcgtatcatttttactaatgtcataataatattaactaataggcaaaaaaaaa

SEQ ID NO: 7634 - DNA, 772 bp, Homo sapiens
  ENST00000490832
aagaaatacctagaatttgatcaccaacaattccaagtatatttttattcattaaaaattaaactgcagtgggcatctgacttagttttcttggatgtcctctgagaaatatgaaagcagattgccctgttttgtcaaaaatcagcatatttttatttcatgtcccaagaaagggaaaatattttgtcaaccaactaattattttacaattaaaaaaatgacagacatctactactcagggactgtatataggagaaaaacttacacacattgaattgaaagtgaaaatcattgggtaatatttgttaattagttgtgttgatgatgatgttagcctagcttttatttggttataagcttttgtatgcacacacattcacaaacacatacacgcatatatacatacgtgtgtgtgcgtgtgttttctttcagtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccg

SEQ ID NO: 7635 - DNA, 1976 bp, Homo sapiens
  ENST00000458311
agcaaatgctcactaccactaataagaacatttctaaatctgatgttctgaggatttttagagcttatagtagcaaaaagaaaagggaaattctatccgagatgtcctttgttgtaggcctaatgagaaaaggttgaagataaagttctggtactcatttaagtgtaatattgaaaattgatattaccgaatctggaacaaccaatttaaaataaggaaagaaagacactgtgttttctaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 7636 - DNA, 2635 bp, Homo sapiens
  ENST00000256999
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 7637 - DNA, 2403 bp, Homo sapiens
  ENST00000356696
ggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatat

SEQ ID NO: 7638 - DNA, 2192 bp, Homo sapiens
  ENST00000525826
agtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttataattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatat

SEQ ID NO: 7639 - DNA, 2697 bp, Homo sapiens
  ENST00000340334
agatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatat

SEQ ID NO: 7640 - DNA, 2225 bp, Homo sapiens
  ENST00000533034
ccaccgcgcgccgcccgcgctggctgtgcgctggggcgctggtgctggcgggtggcttctttctcctcggcttcctcttcggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagagga

SEQ ID NO: 7641 - DNA, 498 bp, Homo sapiens
  ENST00000532018
aattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttggtatgttacccttcctttttcaaattcctcatctgtatggttctattaatctcctaaatataatgggctatcttaggtcatttattatttattgctatttcaagtgatccaatattctgtttatgtctataaatgtattttccattttatggatgctcacgtcttataatataaaaatataaataccttgtaaaac

SEQ ID NO: 7642 - DNA, 611 bp, Homo sapiens
  ENST00000525629
tagaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagaggtactgtaaaatctgaggcaactagcgattggagtcgaccccccagcacaacacagcagccctgcagaaaagtggctagactgtttaa

SEQ ID NO: 7643 - DNA, 387 bp, Homo sapiens
  ENST00000526226
gcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatggtgaatgatcaatccttgaatatcataggaaacttaacatttgaaagagactttattaaagaatttcctttggta

SEQ ID NO: 7644 - DNA, 567 bp, Homo sapiens
  ENST00000529646
tggcgggtggcttctttctcctcggcttcctcttcggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagaggtaaaaacacagtgcaacaaataaaaatgacaaaaagaa

SEQ ID NO: 7645 - DNA, 751 bp, Homo sapiens
  ENST00000533510
tagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgtgaaagtaggcaagagaaattaaaattcagaaatatctcacctaatgtcagagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagg

SEQ ID NO: 7646 - DNA, 540 bp, Homo sapiens
  ENST00000529117
atgtggggtgagcacccctcgagttaggaggagggtagctgggaacggtgcagggctgagttctcgacaagctgctggtaggacagtcactcaggttgagggtagaactgagagaacctgaaactgggcgtaggaaggttccaagtgctggagccctgcaagacagaggaagttttttttttgcttttgttttgttttgttttgttttgtttgtttgtttgtttttttacctctctgtgcattctttcttccttggaagtaacagaggcaagcttgggaactgtgtgaaccagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataa

SEQ ID NO: 7647 - DNA, 660 bp, Homo sapiens
  ENST00000529648
gcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgtaacagaggcaagcttgggaactgtgtgaaccaggtcagcaatctggacaggtctttaccagcgggtcttttgctgtttttcctgggtactgatttgcagacttgatccaactttctaagaaaagcagaaccacacagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatc

SEQ ID NO: 7648 - DNA, 2258 bp, Homo sapiens
  ENST00000343844
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttataattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatat

SEQ ID NO: 7649 - DNA, 3550 bp, Homo sapiens
  ENST00000585836
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 7650 - DNA, 3667 bp, Homo sapiens
  ENST00000417353
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 7651 - DNA, 3775 bp, Homo sapiens
  ENST00000353609
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 7652 - DNA, 3658 bp, Homo sapiens
  ENST00000591858
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 7653 - DNA, 3346 bp, Homo sapiens
  ENST00000443841
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 7654 - DNA, 2170 bp, Homo sapiens
  ENST00000590335
attcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacggtgagtaagggacatcagaacttggcctgggtagggggaagcaagagaggcaggaagtttcttatgaatggaggggggctccactaaggcctcagtgttacagaaaccccaagatccttgctacacgagcgaggaccggaggcttgttttttggctcttgggggttctgaaagaagtagaggttcgggatgggtggaggagtgctgtatccccaaatctcatggcctctatctccctgactcagctcaccccagaggaagaggagaagcgaagggtgcgccgggaacgaaataaactagcagcagctaaatgcaggaaccggcggagggagctgaccgaccgactccaggcggtgaggacaggccctggggtgggagaggggatgttgaggggagctctctccccattctctgccccctctccacctgtacccttatcctgggttgagaactagacgttccacacatggaactaggtactgctgtggccagactgggtagcccagggcacaaacacagacccccatggacttaagtcaactcctggtcccccccccatttcctgaccccacggactactctcctagccttcatttcatcccaaggggccacatggggcccttgaggagaggggcgcccccatcatttctcccatctggtcttcagcaagtaacaacccattttgcctcagtttctccatctctgcaaaccctcatcaaatctcccgggctctttctacccttaacactctggaaagcctgtgaaatgaaattattccacctcctgccctagccacccacagctctcctggtgctggtggcatcccccaaaacccactcccttcctacgtcctcccttggtctgagagttccctgctgtatgcctgcagggtgagctgttactccttgagggaacaagggaattgtcaactttccttctctactttttctcttccccgggaggtagagagggaggggtaatagaagggaacacattaaaaacacataacagtggctcatgcctgtgatcccagcactttgagaggccaaggcaggaggattgcttgagcccaggagtttgagaccagcctgggaaacatagggaggacttgtctctaccaagaaaaaaaaaaa

SEQ ID NO: 7655 - DNA, 1057 bp, Homo sapiens
  ENST00000592436
ttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaac

SEQ ID NO: 7656 - DNA, 3089 bp, Homo sapiens
  ENST00000592811
agagagtagttaagccttcagagcagttccaggagtccatttacgggaggggggagatgagcgctgctgaggcttgggggctcaggtcccgcaccattccccctccgcgacaatctgagagagctccagtggttacttttatctacctgtccgttcaccctaaactgtcactcgtcagtctcactctgagaagagacagtaacttgaaacgttgttctaaactcctaggcccgtcccccaaacacccttttgactgggacccccgcccctgcatgggacctcgcgcagaggggggtgtgtatgtgtgtgagtgtagaggaaggcttggcctaaggcctctccttctccctccccttgcctctggggtgggggtggggtgttgtggctgtgtgtgtggctgtggctccgtcccgggggttctgtcacccggctgtgtccagcctcctctccaccccccatacctaagagtcaccaacccggggtgtgattcaccacccgctggaaccgtgcaacctttccccgaggaagaaggaggaggtagaagccagttgagcagaaatcctctcattaaccactgcgtcacggtgtagtggaagggtgggtgttgtggctttttccctgtgacacacacatccacactcgctcaccctgtgctcactcacggggtcggtgtgtgttatgtgtgttgggtgtgtgtgtgtcggtgtctttgtttgtgtgtctacgcctgtgtgtgtatgtgtcaccccgtaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaa

SEQ ID NO: 7657 - DNA, 2182 bp, Homo sapiens
  ENST00000586113
taagccttcagagcagttccaggagtccatttacgggaggggggagatgagcgctgctgaggcttgggggctcaggtcccgcaccattccccctccgcgacaatctgagagagctccagtggttacttttatctacctgtccgttcaccctaaactgtcactcgtcagtctcactctgagaagagacagtaacttgaaacgttgttctaaactcctaggcccgtcccccaaacacccttttgactgggacccccgcccctgcatgggacctcgcgcagaggggggtgtgtatgtgtgtgagtgtagaggaaggcttggcctaaggcctctccttctccctccccttgcctctggggtgggggtggggtgttgtggctgtgtgtgtggctgtggctccgtcccgggggttctgtcacccggctgtgtccagcctcctctccaccccccatacctaagagtcaccaacccggggtgtgattcaccacccgctggaaccgtgcaacctttccccgaggaagaaggaggaggtagaagccagttgagcagaaatcctctcattaaccactgcgtcacggtgtagtggaagggtgggtgttgtggctttttccctgtgacacacacatccacactcgctcaccctgtgctcactcacggggtcggtgtgtgttatgtgtgttgggtgtgtgtgtgtcggtgtctttgtttgtgtgtctacgcctgtgtgtgtatgtgtcaccccgtaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacggtgagtaagggacatcagaacttggcctgggtagggggaagcaagagaggcaggaagtttcttatgaatggaggggggctccactaaggcctcagtgttacagaaaccccaagatccttgctacacgagcgaggaccggaggcttgttttttggctcttgggggttctgaaagaagtagaggttcgggatgggtggaggagtgctgtatccccaaatctcatggcctctatctccctgactcagctcaccccagaggaagaggagaagcgaagggtgcgccgggaacgaaataaactagcagcagctaaatgcaggaaccggcggagggagctgaccgaccgactccaggcggtgaggacaggccctggggtgggagaggggatgttgaggggagctctctccccattctctgccccctctccacctgtacccttatcctgggttgagaactagacgttccacacatggaactaggtactgctgtggccagactgggtagcccagggcacaaacacagacccccatggacttaagtcaactcctggtcccccccccatttcctgaccccacggactactctcctagccttcatttcatcccaaggggccacatggggcccttgaggagaggggcgcccccatcatttctcccatctggtcttcagcaagtaacaacccattttgcctcagtttctccatctctgcaaaccctcatcaaatctcccgggctctttctacccttaacactctggaaagcctgtgaaatgaaattattccacctcctgccctagccacccacagctctcctggtgctggtggcatcccccaaaacccactcccttcctacgtcctcccttggtctgagagttccctgctgtatgcctgcagggtgagctgttactccttgagggaacaagggaattgtcaactttccttctctactttttctcttccccgggaggtagagagggaggggtaatagaagggaacacattaaaaacacataacagtggctcatgcctgtgatcccagcactttgagaggccaaggcaggaggattgcttgagcccaggagtttgagaccagcctgggaaacatagggaggacttgtctctacc

SEQ ID NO: 7658 - DNA, 3774 bp, Homo sapiens
  ENST00000586615
catttacgggaggggggagatgagcgctgctgaggcttgggggctcaggtcccgcaccattccccctccgcgacaatctgagagagctccagtggttacttttatctacctgtccgttcaccctaaactgtcactcgtcagtctcactctgagaagagacagtaacttgaaacgttgttctaaactcctaggcccgtcccccaaacacccttttgactgggacccccgcccctgcatgggacctcgcgcagaggggggtgtgtatgtgtgtgagtgtagaggaaggcttggcctaaggcctctccttctccctccccttgcctctggggtgggggtggggtgttgtggctgtgtgtgtggctgtggctccgtcccgggggttctgtcacccggctgtgtccagcctcctctccaccccccatacctaagagtcaccaacccggggtgtgattcaccacccgctggaaccgtgcaacctttccccgaggaagaaggaggaggtagaagccagttgagcagaaatcctctcattaaccactgcgtcacggtgtagtggaagggtgggtgttgtggctttttccctgtgacacacacatccacactcgctcaccctgtgctcactcacggggtcggtgtgtgttatgtgtgttgggtgtgtgtgtgtcggtgtctttgtttgtgtgtctacgcctgtgtgtgtatgtgtcaccccgtaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgca

SEQ ID NO: 7659 - DNA, 580 bp, Homo sapiens
  ENST00000589593
gtgtgtggctgtggctccgtcccgggggttctgtcacccggctgtgtccagcctcctctccaccccccatacctaagagtcaccaacccggggtgtgattcaccacccgctggaaccgtgcaacctttccccgaggaagaaggaggaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggag

SEQ ID NO: 7660 - DNA, 740 bp, Homo sapiens
  ENST00000587358
cgaggaccggaggcttgttttttggctcttgggggttctgaaagaagtagaggttcgggatgggtggaggagtgctgtatccccaaatctcatggcctctatctccctgactcagctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagagg

SEQ ID NO: 7661 - DNA, 1468 bp, Homo sapiens
  ENST00000615753
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtga

SEQ ID NO: 7662 - DNA, 393 bp, Homo sapiens
  ENST00000460736
cgaaagcgaggaaacccgcactcgcgtcctctaacgcaaatgaccatctttggcaacgtgcgccaatggaacagaccaagggcgctgggcccgggggaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagag

SEQ ID NO: 7663 - DNA, 5829 bp, Homo sapiens
  ENST00000379619
gaatccacatggtacagggctggagaataaagagtaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcgattggtccctggcaggttgctgtccctcacatccctctctttccgtggcaggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctgtttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaa

SEQ ID NO: 7664 - DNA, 6708 bp, Homo sapiens
  ENST00000264716
gtagtgactcatctcgggcagagcgctagggctccgagcgaaccagcgagcgagcgaacgagcggcgctcggcggggacagaaagagggagagagagagagagagagagggagaggcgcggccgggcgaggcgggcccgtccgggagcgggctccggggaaggggtgcgggtctgggcgccggagcggggagcggggccgcgtccctctcagcgccagctctacttgagccccacgagccgctgtccccctggcgcgctcggggccgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctgtttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaa

SEQ ID NO: 7665 - DNA, 889 bp, Homo sapiens
  ENST00000436647
caggatgtgagcggaggcaattcccggttttggaagaaaatcagacaggaaaccagtgctaggaagaaggaagagaactcagtccagcagagtgtaatagggcctcattaccgaagcaaaaagcagctgttggctaattcctagcatgctgtaacacatgagtattttgcaattagcaataaccagtgcacggggtttcgcatagacgcctgcccattcggcccggcagtgtgtgaggcgcctttcaaaccggagggattggcaagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggccca

SEQ ID NO: 7666 - DNA, 2862 bp, Homo sapiens
  ENST00000250448
cgcgcggccgcccgtcgcttcgcacagggctggatggttgtattgggcagggtggctccaggatgttaggaactgtgaagatggaagggcatgaaaccagcgactggaacagctactacgcagacacgcaggaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgaatggcctgggcccctacgcggccgccatgaacccgtgcatgagccccatggcgtacgcgccgtccaacctgggccgcagccgcgcgggcggcggcggcgacgccaagacgttcaagcgcagctacccgcacgccaagccgccctactcgtacatctcgctcatcaccatggccatccagcaggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggcccccgggcccgccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgcgaagtttaatgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacatgatacattctcaagagttgcttgaccgaaagttacaaggaccccaacccctttgtcctctctacccacagatggccctgggaatcaattcctcaggaattgccctcaagaactctgcttcttgctttgcagagtgccatggtcatgtcattctgaggtcacataacacataaaattagtttctatgagtgtataccatttaaagaatttttttttcagtaaaagggaatattacaatgttggaggagagataagttatagggagctggatttcaaaacgtggtccaagattcaaaaatcctattgatagtggccattttaatcattgccatcgtgtgcttgtttcatccagtgttatgcactttccacagttggacatggtgttagtatagccagacgggtttcattattatttctctttgctttctcaatgttaatttattgcatggtttattctttttctttacagctgaaattgctttaaatgatggttaaaattacaaattaaattgttaatttttatcaatgtgattgtaattaaaaatattttgatttaaataacaaaaataataccagattttaagccgtggaaaatgttcttgatcatttgcagttaaggactttaaataaatcaaatgttaacaaaa

SEQ ID NO: 7667 - DNA, 1806 bp, Homo sapiens
  ENST00000545425
atttttacaatgtgcacaaaaggattacagggaaaaccagttacagggaggactaccacctattaaaagtatttttctggaaacagctggcgattaccctccaaaagtttaattaccattattgaaaacgcgtattggaactgccttggataatcttgggaagagggaaagaaaataaagccccaaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgaatggcctgggcccctacgcggccgccatgaacccgtgcatgagccccatggcgtacgcgccgtccaacctgggccgcagccgcgcgggcggcggcggcgacgccaagacgttcaagcgcagctacccgcacgccaagccgccctactcgtacatctcgctcatcaccatggccatccagcaggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggcccccgggcccgccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgcgaagtttaatgatccacaagtgtatatatg

SEQ ID NO: 7668 - DNA, 507 bp, Homo sapiens
  ENST00000553751
ttcgcccgggtggcgttgggcccgcgcgggcgctcgggtgactgcagctgctcagctcccctcccccgccccgcgccgcgcggccgcccgtcgcttcgcacagggctggatggttgtattgggcagggtggctccaggatgttaggaactgtgaagatggaagggcatgaaaccagcgactggaacagctactacgcagacacgcaggagctggcgattaccctccaaaagtttaattaccattattgaaaacgcgtattggaactgccttggataatcttgggaagagggaaagaaaataaagccccaaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcgg

SEQ ID NO: 7669 - DNA, 789 bp, Homo sapiens
  ENST00000554607
aagggcatgaaaccagcgactggaacagctactacgcagacacgcaggagcgagcgggagcaggagccgggcccggggtgcagcgggcgggcgagcgccggtgcgagttggaagcaactctgagaaagccggagcatacccacaaggcgacctcttcgtcccaccgtttaattcgcagacgtcttctgattaaagcgctctgccgccaagttgggtgtctcaataatgaaacgatttctaaattttgtaaaacttgttcttcaaaagccctatttggggagaagtgtgctccttctctaaaaccgctgggtggcgctagtgcgaccaaaatcttcttcacaactctgggccgagaacctgtttctcttcattgtccccttggtggcacgttcatgggggttatttttacaatgtgcacaaaaggattacagggaaaaccagttacagggaggactaccacctattaaaagtatttttctggaaacagctggcgattaccctccaaaagtttaattaccattattgaaaacgcgtattggaactgccttggataatcttgggaagagggaaagaaaataaagccccaaggtaaaaaatacttttaagacgtggacagaaaaatataggatcacgtaatattttgatggtaactgacttatttagatttatgtattcacaagtttacctctgagtttatttgcataccatagtttactgggtgttcctatttaaatctatttgttctcatattttcaaattgagtcatacttgctgattaaaataaactta

SEQ ID NO: 7670 - DNA, 392 bp, Homo sapiens
  ENST00000557418
acaaaaaaaaaaagttatgtcataaagatataaaccggtgctgtgactcacctgctcttagccgcaggtgcgagcgtctttgtgcggcggacaaatggggagaggacgaggaggtgggcactcaagcgacgtaagatccacatcagctcaactgcacttgcctcgcagaggcagcccgctcacttcccgcggaggcgctccccggcgccgcgctccgcggcagccgcctgcccccggcgctgcccccgcccgccgcgccgccgccgccgccgcgcacgccgcgccccgcagctctgggcttcctcttcgcccgggtggcgttgggcccgcgcgggcgctcgggtgactgcagctgctcagctcccctcccccgccccgcgccgcgcggccgc

SEQ ID NO: 7671 - DNA, 2422 bp, Homo sapiens
  ENST00000419308
cccgcccacttccaactaccgcctccggcctgcccagggagagagagggagtggagcccagggagagggagcgcgagagagggagggaggaggggacggtgctttggctgacttttttttaaaagagggtgggggtggggggtgattgctggtcgtttgttgtggctgttaaattttaaactgccatgcactcggcttccagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccaaccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggttttatcccttgaatcttttcttccagatttttcttttctttacttggcttacaaaatatacaggcttggaaattatttcaagaaggagggagggataccctgtctggttgcaggttgtattttattttggcccagggagtgttgctgttttcccaacattttattaataaaattttcagacat

SEQ ID NO: 7672 - DNA, 2401 bp, Homo sapiens
  ENST00000377115
gctagaggggctgcttgcgccaggcgccggccgccccactgcgggtccctggcggccggtgtctgaggagtcggagagccgaggcggccagaccgtgcgccccgcgcttctcccgaggccgttccgggtctgaactgtaacagggaggggcctcgcaggagcagcagcgggcgagttaaagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccaaccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggttttatcccttgaatcttttcttccagatttttcttttctttacttggcttacaaaatatacaggcttggaaattatttcaagaaggagggagggataccctgtctggttgcaggttgtattttattttggcccagggagtgttgctgttttcccaacattttattaataaaattttcagacat

SEQ ID NO: 7673 - DNA, 100 bp, Homo sapiens
  ENST00000636604
ctggaaccgactccggagagtgagggccagggtgatcgctcgcagctacccgcttccaattcggattagaagctgaggctggagcggcgaggagaaaacg

SEQ ID NO: 7674 - DNA, 147 bp, Homo sapiens
  ENST00000637220
aatcatttcacgctagaccgactacgaaaacgtaccgggccgtccacctcagagggagccctgtgtgccattataagtggtgggtgatcgctcgcagctacccgcttccaattcggattagaagctgaggctggagcggcgaggaga

SEQ ID NO: 7675 - DNA, 166 bp, Homo sapiens
  ENST00000636893
aaagtgagtaggaaggggaaggcccacaaatctctccagccgggtgatcgctcgcagctacccgcttccaattcggattagaagctgaggctggagcggcgaggagaaaacgacatcgagtcaccccgcgcgtgagcgacgctctggagcaggagagaaggaaaag

SEQ ID NO: 7676 - DNA, 100 bp, Homo sapiens
  ENST00000637351
gagaaatccagagcttggaaataaatgtttgggaccatgtcactatcaacactgattgttggaacccttgaatttttccacatggtgatcgctcgcagct

SEQ ID NO: 7677 - DNA, 172 bp, Homo sapiens
  ENST00000637817
tgaatttttccacatgtaaatacagtttgttttaaagtgagaagatatgtagacataggtaaagatacatacatacagtggaaggacatttgagggtgatcgctcgcagctacccgcttccaattcggattagaagctgaggctggagcggcgaggagaaaacgacatcgag

SEQ ID NO: 7678 - DNA, 111 bp, Homo sapiens
  ENST00000636346
ccaaatctgccagatatcttaatgaaagtttatccaagtgaagaaatgcttacattttataattatttaccttctagaggaaggaaaagggtgatcgctcgcagctacccg

SEQ ID NO: 7679 - DNA, 158 bp, Homo sapiens
  ENST00000636353
aattatttaccttctagaggaaggaaaaggtgcctttcatttatgcttctccacctccctcttctctggggctacatcctccgtaaaatgtgggtgatcgctcgcagctacccgcttccaattcggattagaagctgaggctggagcggcgaggagaa

SEQ ID NO: 7680 - DNA, 4890 bp, Homo sapiens
  ENST00000313071
ttcaacctccaaccgaaccttcccagttccaaagcccaagaagctgggactgtgagatccacgttcccaaggctccccggtgctttccagcagcactcagggttggcaagagctggcttcagtatactgttatttcaggaatgaggcccgcacaaaataaaagcatttgagaaacggaaaggaaaaaaaaggagtgaaaataggaaggcttaaaaaaaaaaccggaaagaaatagacgcccacccttattttccctccaatgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaaggaaaaggaagagacacacgtatatagcatgtgttacctgatttatttcgagattgtttggtactgttttctctctgggcacctctcatttcggaaggccatcagaggcgcccactactgagcggccccggccgccgcagcagcacccggagccccagtcccggtttccccgcggtgccggagcccggagctcgccgccgcccaggcctcaggaatcgagtaagtaacccctgtttggccccgcgctcctctgcccacttcctcctcctcatctcatcgctcccaaagctctcccacaccctcctcccccgaagtaaaggacacccccgcacacacgccagcggtgggccttatctccccccttatccaaagctgcgctagactattacctacaaagggcacaattttcctgctggctcagaaatgccagacactggcctgcaaggccgactcggaaaagtagtgcctcgcctctacctcctccatttcctgccctctcgcatcctctccctgcactcccactcttcccactaccaccaccacccccgctttcaaaaataaaattggatacaaactttaatcactaaggacaaatattgacgcttaaacgaaaatgacccagtacaatgaggaggaagccggaaatgtgagctattggccctaggaggggaatttcggtggagcggagccggcggggtggagggggtggcgggggcgcagggaagggctgcggcaccgcgtgctcccgccggcgtatccctacgcggctccgcgcggcctcggggtccgaggcccgcggagagggggaggcgagcgcccgagggggcggcagccggcgggcggggcgggggtgggtgggcccggcccctccgattggtcgacggcgagagagacgctcccgcacgccgccagctctgattggcccagcggtaggaaaggttaaaccaaaaatttttttacagccctagtgtgcgcctgtagctcggaaaattaattgtggctatagccgcctcgatcgctgtctccccagcctcgccgcggccgctccgggacgcgcccgcccgccgcccggctctccccccctttgggctgctgctgctgctgctgtgactgctgctgcgagaggaggaggaggaggaggaagcagcgggggggggagcggggggtggggggggagaccaagaagtacagttgggagcgagggagcttcacccccggggcggtggttgtttcttttttctttctttcttttttcttttcctttttttttttttttctaattcctgaggggtggttgctgcttttgctacatgacttgccagcgcccgagcctgcggtccaactgcgctgctgccggagcgctcagtgccgccgctgccgcccgcgccccccgcgccccgttcggcacccaccggtcgccgccgcccgccgcgccgctgtcccgctcccgcgccgccgccgccgtttccccccgacgactgggtgatgctggacatgggagataggaaagaggtgaaaatgatccccaagtcctcgttcagcatcaacagcctggtgcccgaggcggtccagaacgacaaccaccacgcgagccacggccaccacaacagccaccacccccagcaccaccaccaccaccaccaccatcaccaccacccgccgccgcccgccccgcaaccgccgccgccgccgcagcagcagcagccgccgccgccgccgcccccggcaccgcagcccccccagacgcggggcgccccggccgccgacgacgacaagggcccccagcagctgctgctcccgccgccgccaccgccaccaccggccgccgccctggacggggctaaagcggacgggctgggcggcaagggcgagccgggcggcgggccgggggagctggcgcccgtcgggccggacgagaaggagaagggcgccggcgccgggggggaggagaagaagggggcgggcgagggcggcaaggacggggaggggggcaaggagggcgagaagaagaacggcaagtacgagaagccgccgttcagctacaacgcgctcatcatgatggccatccggcagagccccgagaagcggctcacgctcaacggcatctacgagttcatcatgaagaacttcccttactaccgcgagaacaagcagggctggcagaactccatccgccacaatctgtccctcaacaagtgcttcgtgaaggtgccgcgccactacgacgacccgggcaagggcaactactggatgctggacccgtcgagcgacgacgtgttcatcggcggcaccacgggcaagctgcggcgccgctccaccacctcgcgggccaagctggccttcaagcgcggtgcgcgcctcacctccaccggcctcaccttcatggaccgcgccggctccctctactggcccatgtcgcccttcctgtccctgcaccacccccgcgccagcagcactttgagttacaacggcaccacgtcggcctaccccagccaccccatgccctacagctccgtgttgactcagaactcgctgggcaacaaccactccttctccaccgccaacggcctgagcgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccgcgtcctcctccacgtcgccgcaggccccctcgaccctgccctgtgagtctttaagaccctctttgccaagttttacgacgggactgtctgggggactgtctgattatttcacacatcaaaatcaggggtcttcttccaaccctttaatacattaacatccctgggaccagactgtaagtgaacgttttacacacatttgcattgtaaatgataattaaaaaaataagtccaggtattttttattaagcccccccctcccatttctgtacgtttgttcagtctctagggttgtttattattctaacaaggtgtggagtgtcagcgaggtgcaatgtggggagaatacattgtagaatataaggtttggaagtcaaattatagtagaatgtgtatctaaatagtgactgctttgccatttcattcaaacctgacaagtctatctctaagagccgccagatttccatgtgtgcagtattataagttatcatggaactatatggtggacgcagaccttgagaacaacctaaattatggggagaattttaaaatgttaaactgtaatttgtatttaaaaagcattcgtagtaaaggtgcccaagaaattattttggccatttattgttttgtccttttctttaaagaactgtttttttttcttttgtttacttttagaccaaagattgggttctagaaaatgcacttggtatactaagtattaaaacaaacaaaaaggaaagttgtttcagttggcaacactgcccattcaattgaatcagaaggggacaaaattaacgattgccttcagtttgtgttgtgtatattttgatgtatgtggtcactaacaggtcacttttattttttctaaatgtagtgaaatgttaatacctattgtacttataggtaaaccttgcaaatatgtaacctgtgttgcgcaaatgccgcataaatttgagtgattgttaatgttgtcttaaaatttcttgattgtgatactgtggtcatatgcccgtgtttgtcacttacaaaaatgtttactatgaacacacagaaataaaaaataggctaaattcatatatatcttgatacttttgtctcttttattaagtagagctaattttttaaagaccaatcaacttatagggaattcaaaggctttttcagccaaactaaaatttaaactgctcctttaatttgaactgactctaaaaatgaaaatagtatttttccctttgtgaacaaattttacaaggagcagcctatttaataaacactagctttaaacaaagtataggcttttcagctgatacctgtaagtttctgtggatatacagcaaaaagagatataatttaattttctgtgcatagctctttaccctgtgtttatttccaaatccattaatagaatgccatttatatattttgtttcaggtatattgttaatagagcttggcaaattataaataaatatatgtatatggttagatagaagtgactataatgcacacatatgtaatatatatagacacacagagcccttcagttcaggtacaatttgcgctatgaatgctgcaaacatttttgtttaaatatttgtatttatactttctaagtcagcatttatttttgtggctgtttacccacaatgaaagagttctaataaagatgtgctgaagttgcaatata

SEQ ID NO: 7681 - DNA, 2503 bp, Homo sapiens
  ENST00000377317
gttgagtcaatgtgtccccctcttgttcctagggtgcgggcttcatggccttctcctccaggaagctccacctgatcatgtcctgggtggatatccagcccccatagttcagggcctactagcagctgctagatcttgaactccaggagcgccccacgccttgggagcttggcatgggctaaatactcccccatttgttaaatggggtcctgaaacctgaccagggaagacgggataaagtagccatgggtcatcgcagcccctttgaagccgggcctggccacccaaaggcaactcaggggtggagactgaggcctcaggagaagcccccactagaatgctctctgcccctcccttccagattaaccaaaacctgctaattgtggaagccctcggcatgctcccctcccccacagcctcttcctcccttccctcccctcccccttccatccgaatgataaaggccccagcccgcctgccccagcccggcctcaggtcccggccctgccttctacactgccccaccgccctgcaccctccacccggccaggcccctgcccacgctgtctaccgtcccgcatggggccctgcagcggctcccgcctggggcccccagaggcagagtcgccctcccagccccctaagaggaggaagaagaggtacctgcgacatgacaagcccccctacacctacttggccatgatcgccttggtgattcaggccgctccctcccgcagactgaagctggcccagatcatccgtcaggtccaggccgtgttccccttcttcagggaagactacgagggctggaaagactccattcgccacaacctttcctccaaccgatgcttccgcaaggtgcccaaggaccctgcaaagccccaggccaagggcaacttctgggcggtcgacgtgagcctgatcccagctgaggcgctccggctgcagaacaccgccctgtgccggcgctggcagaacggaggtgcgcgtggagccttcgccaaggacctgggcccctacgtgctgcacggccggccataccggccgcccagtcccccgccaccacccagtgagggcttcagcatcaagtccctgctaggagggtccggggagggggcaccctggccggggctagctccacagagcagcccagttcctgcaggcacagggaacagtggggaggaggcggtgcccaccccaccccttccctcttctgagaggcctctgtggcccctctgcccccttcctggccccacgagagtggagggggagactgtgcaggggggagccatcgggccctcaaccctctccccagagcctagggcctggcctctccacttactgcagggcaccgcagttcctgggggacggtccagcgggggacacagggcctccctctgggggcagctgcccacctcctacttgcctatctacactcccaatgtggtaatgcccttggcaccaccacccacctcctgtccccagtgtccgtcaaccagccctgcctactggggggtggcccctgaaacccgagggcccccagggctgctctgcgatctagacgccctcttccaaggggtgccacccaacaaaagcatctacgacgtttgggtcagccaccctcgggacctggcggcccctggcccaggctggctgctctcctggtgcagcctgtgaggctcttaagacaggggccactcctccctcccgctcccacccccaccttgttgacagggagccaaggcgaggcggctgtctgcgaccacagcagcctcgaaacaccaggcagcagccttgctgggagtccacggtgtttattgggccaccccacgcatggccgtggcccagctgggcacaaccctcaccctggtctgtcatgcctgtttttcctacactcagcggcaaagctgcaggagcagggctgagcctggaatagcccttcctagtcccctcttctcagcccactacccatccatcagtcaccagccgtcacctcccctcccgtgctccaggctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgttttaatgccatgcctgatttttgggtcaggagtggtgacttgggtaaccacttggcgggggggcctgggattccctgctgtgtgccgtgataacagcaaatggtgataaggagaaagccaagacctgtggcctgatgcagggctgggggcggggggtgatcacttcagcaggcacaacacacttcactggctgcggaggtggaggggtgactctgggagctcaggggcaatggatccaaagaggctagggagcttgtgccctgggagacggggtacagggactttactaccgcctctgccagcagagacctggcctgagacccca

SEQ ID NO: 7682 - DNA, 492 bp, Homo sapiens
  ENST00000525197
tacactgccccaccgccctgcaccctccacccggccaggcccctgcccacgctgtctaccgtcccgcatggggccctgcagcggctcccgcctggggcccccagaggcagagtcgccctcccagccccctaagaggaggaagaagaggtacctgcgacatgacaagcccccctacacctacttggccatgatcgccttggtgattcaggccgctccctcccgcagactgaagctggcccagggaagactacgagggctggaaagactccattcgccacaacctttcctccaaccgatgcttccgcaaggtgcccaaggaccctgcaaagccccaggccaagggcaacttctgggcggtcgacgtgagcctgatcccagctgaggcgctccggctgcagaacaccgccctgtgccggcgctggcagaacggaggtgcgcgtggagccttcgccaaggacctgggcccctacgtgctgcacggccggccatacc

SEQ ID NO: 7683 - DNA, 5910 bp, Homo sapiens
  ENST00000373063
gccgtccctgcggaccggacagtgcggccggcggccggcggccgggacggagcccccagcccgcgaggagggcgcggcgcaggcggcggcggcgcggcggggaggagcccgggccggaaccagggctgggccgggggcggggacgccggggtccgggagcccgggagccggagcgagctgacgagcgtcgcggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccagtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccgggccctgtgtgtgtcaccgaggtgcgggaggggaggagcattaaagctgaaagatcgctctgctcggggagcctgggcagagcagcagcaacgtgagggtcgctgtggtggtggtttctgtgagtggatggaatgagcagccctgcaggggcgctgggcatgtgccctcactgtggacagggcccacccacctccggttcccctgtgcctcctgtcccttccacgcttaaacagggttctctgtcattttcctgttttcttccagagtcccaatcctttgccctagttctttcactagtttgaaatccaagttcttgccagagtgttggagcaaggcagctgatttgctgcagggatggagaggaccaccgccgcagggttcttttacctgtgccaccagctctggagacatccacacccattcccaggtgtccttccaggcccattgtccacgtcttcaagggggctgcctggataggcgtgtgtgtgtgtagtgcccaggtgtggtggtggcatcctgaagcagtaggaccattagtgtgcgtgcacacccacgtggcacactgtgtggtgaccatggtcatcatagtgggctcacggcggaaacgggatcattcaacctatacaaaggggaccctggataggctgcaaggaaagaggccaagggccaagctgctaagccaaagatggcccctgacacctcccccagccccagcacaccagcctgcacctcttatcccgtgttaagtcctggttccccacctgctgcccctcctcaacacagagcccctcccgccgcctcagacccctgtgcacatccccagggcctcagccgtctcattggtctttattttttattttttttaagatggagtttcgctcttattgcccagactggagtgcagtgatgctatctcggctcactgcaacctttgcctcccaggttcaagtgattctcctgcctcagcctcccaagtagctgggattacaggcgtgcaccaccacgccgggctaaatttttttgtatttttagtagagacggggtttctctatgttggtcaggctgatctcgaactcccgacctcaggtgatccgccagcctcagcctcccaaagtgctgggattacaggcgtgagccactgcacccggctctcactggtcttacgccaccttctggacactccctccttgagggcagaaaggagtcccaggcctgtccctagggacaaggcccagggaagagtgtatttggggagcaggggaggggagggtgttgagaaagctgaactggagtcaatcacccttcccacaaatcaccaaactgctggaactctccagccaaatgctgggagaaggacctggagggtgagtctttgctgacctctctctactctcaggcatgtcttttgtccttttcgtccatctatttctgtctgtcgctcactcgccccgctttctctgtctcaccttcatccactctgcaggcctgctccaccacagccctaatcctctggacgcttgtgtagggcctggggtgaattccctgtcccccatggtacctcgagaggggctggggagctcagcttggtctcagagtctccccaccagatactgtttaaaaaagtagcactgatgtgttttgtaatctgcccctcccagccctccgtggaggctgccagggccttgtacggtaaacctagctgcatgtaatctgtggacaatggcattctctacaatgcaataaaaacaattacccatga

SEQ ID NO: 7684 - DNA, 3341 bp, Homo sapiens
  ENST00000409208
ggggtccgggagcccgggagccggagcgagctgacgagcgtcgcggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccagtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaacc

SEQ ID NO: 7685 - DNA, 3300 bp, Homo sapiens
  ENST00000373057
gcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaa

SEQ ID NO: 7686 - DNA, 3745 bp, Homo sapiens
  ENST00000307972
cgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccggg

SEQ ID NO: 7687 - DNA, 367 bp, Homo sapiens
  ENST00000451305
ctggctgtgtgccccagattctactgtttcctgtctgatcccacaccttctgcattctcctttttcttctggagaatgagcccctcccgtggaggagccatggcatggagggagagttggggcccgcactctccagaggggaggcttacggacatcacaccagttcataccagctgctggggaatgctcagaaactgccctttcctccttggcctgacacagctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaaca

SEQ ID NO: 7688 - DNA, 5948 bp, Homo sapiens
  ENST00000373060
gccgtccctgcggaccggacagtgcggccggcggccggcggccgggacggagcccccagcccgcgaggagggcgcggcgcaggcggcggcggcgcggcggggaggagcccgggccggaaccagggctgggccgggggcggggacgccggggtccgggagcccgggagccggagcgagctgacgagcgtcgcggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccgggccctgtgtgtgtcaccgaggtgcgggaggggaggagcattaaagctgaaagatcgctctgctcggggagcctgggcagagcagcagcaacgtgagggtcgctgtggtggtggtttctgtgagtggatggaatgagcagccctgcaggggcgctgggcatgtgccctcactgtggacagggcccacccacctccggttcccctgtgcctcctgtcccttccacgcttaaacagggttctctgtcattttcctgttttcttccagagtcccaatcctttgccctagttctttcactagtttgaaatccaagttcttgccagagtgttggagcaaggcagctgatttgctgcagggatggagaggaccaccgccgcagggttcttttacctgtgccaccagctctggagacatccacacccattcccaggtgtccttccaggcccattgtccacgtcttcaagggggctgcctggataggcgtgtgtgtgtgtagtgcccaggtgtggtggtggcatcctgaagcagtaggaccattagtgtgcgtgcacacccacgtggcacactgtgtggtgaccatggtcatcatagtgggctcacggcggaaacgggatcattcaacctatacaaaggggaccctggataggctgcaaggaaagaggccaagggccaagctgctaagccaaagatggcccctgacacctcccccagccccagcacaccagcctgcacctcttatcccgtgttaagtcctggttccccacctgctgcccctcctcaacacagagcccctcccgccgcctcagacccctgtgcacatccccagggcctcagccgtctcattggtctttattttttattttttttaagatggagtttcgctcttattgcccagactggagtgcagtgatgctatctcggctcactgcaacctttgcctcccaggttcaagtgattctcctgcctcagcctcccaagtagctgggattacaggcgtgcaccaccacgccgggctaaatttttttgtatttttagtagagacggggtttctctatgttggtcaggctgatctcgaactcccgacctcaggtgatccgccagcctcagcctcccaaagtgctgggattacaggcgtgagccactgcacccggctctcactggtcttacgccaccttctggacactccctccttgagggcagaaaggagtcccaggcctgtccctagggacaaggcccagggaagagtgtatttggggagcaggggaggggagggtgttgagaaagctgaactggagtcaatcacccttcccacaaatcaccaaactgctggaactctccagccaaatgctgggagaaggacctggagggtgagtctttgctgacctctctctactctcaggcatgtcttttgtccttttcgtccatctatttctgtctgtcgctcactcgccccgctttctctgtctcaccttcatccactctgcaggcctgctccaccacagccctaatcctctggacgcttgtgtagggcctggggtgaattccctgtcccccatggtacctcgagaggggctggggagctcagcttggtctcagagtctccccaccagatactgtttaaaaaagtagcactgatgtgttttgtaatctgcccctcccagccctccgtggaggctgccagggccttgtacggtaaacctagctgcatgtaatctgtggacaatggcattctctacaatgcaataaaaacaattacccatg

SEQ ID NO: 7689 - DNA, 7142 bp, Homo sapiens
  ENST00000325942
aactttaaaaagctgcttcggacaaaccagagccaggatttccactgtcggggacccgggatcggaagggtctagcccgagggaaatgctggaagatcccatcggccagtgaccagcaactttccggcgagattttgacgcggagaactgtgctctgcctcctcttattctcccaaagctcacgttggcgtcctgccttgcgggggaactcggcgcgctctctgcctgagcagcgagtgaattgaaccccagcccgctccggcgcctccgggctgatgagtgtcgctctccgcccgtccatctctttttcccggaggtaaaggcccgcggtcccccaccttcagtgcgcccgggttccaagcgccggagccagcgttttggcggagccgcttcttggatgctgaaggctgggctcctccatcgtgggtgccgaggcggcgatgggtgtcctcaaagtgtggctcgggctggccctagcgttggcggaatttgcagtattgcctcatcattccgaaggtgcttgtgtctatcaggattccttgttggcggatgccacaatttggaagcccgattcatgccagagctgccgttgccatggtgatattgttatctgcaaacctgctgtttgcagaaaccctcaatgtgcctttgagaagggagaagtgcttcaaatagctgccaaccaatgctgtcctgagtgtgttttgaggactccaggatcttgccatcatgaaaagaaaatccatgagcatgggacagaatgggcctcttctccatgtagtgtgtgctcttgcaatcatggggaagtccgatgtaccccccaaccatgcccaccgctgtcatgtggacaccaggagctggcattcatccctgaaggaagctgctgcccagtttgtgtgggccttgggaaaccctgttcctatgaaggccatgtgtttcaggatggggaggactggcggctgagccggtgtgccaaatgtctgtgtagaaatggggttgcccagtgcttcacagctcagtgtcagcctctattttgtaaccaggatgagactgtagtccgagtccctggaaaatgttgcccgcagtgctctgcaagatcctgctctgcagctggccaagtatacgagcatggtgagcagtggagcgaaaatgcctgcaccacgtgtatatgtgaccggggtgaggtcaggtgtcacaagcaggcctgcctgcccctgagatgcggaaagggtcagagcagggctcggcgtcatgggcaatgctgtgaggaatgtgtgtctcctgccgggagctgctcctatgatggagttgtgcggtaccaggacgaaatgtggaagggctcggcctgtgagttctgcatgtgtgatcatggccaagtgacctgccagactggagagtgtgccaaagtggagtgtgcccgggatgaagaattaattcacttagatggaaagtgttgtcctgaatgcatttcaaggaatggttattgtgtttatgaagaaactggagaatttatgtcatcaaatgctagtgaagttaaacgtattccagagggagagaagtgggaagatggcccttgcaaggtgtgtgagtgccgaggggctcaggtaacttgctacgagccctcttgcccaccatgtccagtgggcacactggccttagaggtgaagggacagtgctgtccagactgcacatcagttcattgccatccagattgtttgacatgctctcagtctccagaccactgtgacctctgccaagatcctaccaagttactgcagaatggatggtgtgtgcacagctgtggactgggtttttaccaagctggcagtctctgtttagcctgccagccccagtgctccacgtgtaccagtgggctggagtgctcatcctgccagcctcccctgctgatgcggcacgggcagtgtgtgcctacctgtggggacggcttctaccaagatcgccattcctgtgcagtctgccatgagtcctgtgcaggttgctggggcccaacggagaagcactgcttggcctgcagagatcccctccacgtgctgagagatggcggctgtgagagcagctgtggaaaaggcttctacaacaggcagggcacctgtagcgcttgtgaccaatcctgtgacagttgtggccccagtagccccaggtgtcttacctgtactgagaagacagtgctgcatgatgggaaatgcatgtctgaatgccctggcgggtactatgctgatgccactggcaggtgcaaagtttgtcataactcatgtgccagctgctctgggcccacaccctctcactgtacagcctgcagcccccccaaggctctgcgtcaaggccactgtctgccccgctgtggagagggtttctactctgaccatggagtctgcaaagcctgtcactcctcctgcctggcttgtatgggtcccgcaccctctcactgtactgggtgtaagaagccagaggaaggactgcaagtggagcagctgtctgacgtgggcatcccctctggcgagtgtctagcccagtgtagagcccatttttacttggagagcactggcatatgtgaagcttgccaccagtcctgtttcagatgtgcagggaaaagcccacataactgcacagactgtgggccttcccatgtgctgttggatgggcagtgcctctcccagtgcccagatggctactttcaccaggaaggtagttgcacagagtgtcacccaacctgcaggcagtgtcatgggccgttggagtctgactgcatctcctgttaccctcacatctctcttaccaatggtaactgcaggaccagctgcagggaagagcagttcctcaacctcgtgggatactgtgctgactgccatcacctgtgccagcactgtgcagctgatctccacaacactgggagcatctgcctcaggtgccagaatgcccactacctgctgctcggggaccactgtgttcctgactgcccttcaggatactatgcagagagaggagcttgtaaaaaatgccactcctcctgcagaacctgccagggcagaggacctttctcctgctcctcatgtgacaccaacctcgtgctgtcccacactggcacctgcagcaccacctgcttccctgggcactatcttgatgacaatcatgtttgccagccatgcaacacacactgtggaagctgtgattcacaggccagctgtacctcctgccgagatccaaacaaggttctgctctttggggaatgtcaatacgagagctgcgccccacagtactatcttgacttctccaccaacacgtgcaaagagtgtgattggagctgcagtgcatgcagtgggcccctgaaaacagactgcctgcagtgcatggatggctatgttctccaggatggggcctgcgtggagcagtgcttgtcatcattttaccaggactcgggcctctgcaagaactgtgacagctactgtctccagtgccaaggtccccatgagtgtacccgctgcaaagggccatttctcctcttggaagcccagtgtgtccaggaatgtgggaaggggtactttgcagatcatgcaaagcacaaatgcacagcctgccctcaggggtgcttgcagtgcagccacagggaccgttgtcacctctgtgaccatgggttctttctgaagagtggcctctgtgtttacaactgtgttcctggcttttctgtccacacctctaatgaaacatgttctggcaaaatacacacccctagtcttcatgtgaatggttccctgatcctcccaattggttcaataaagccactggatttttccctcctgaatgtccaagaccaggagggtagggtcgaagatctcctatttcatgttgtgagcactcccaccaatggtcagctagtgctctcaagaaatggaaaagaggttcagctggacaaggctggccgttttagctggaaagatgtgaacgagaagaaagtgcgttttgtgcacagcaaagaaaaactcaggaaaggttaccttttcctgaaaattagtgaccagcagttcttctctgagccacagctgatcaacatacaagcattttcaacacaggccccctatgtgctgagaaatgaagttctccacattagcagaggagagagggcaaccatcaccacccagatgcttgacatccgagatgatgacaacccacaggatgtggtcattgaaataatcgatcctccacttcatggccaattgcttcagacacttcagtccccggcaacccctatctatcaattccagctggatgaactctctagaggccttctccactatgctcatgatggttcagacagcacatccgatgttgcagtcttgcaggccaatgatggacactccttccataatatactgttccaagtgaagaccgtgcctcagaatgacaggggtcttcagcttgtggctaattcgatggtgtgggttccagaaggggggatgctgcagatcaccaacagaatcttacaggccgaggctcctggtgccagtgctgaagaaatcatctacaagattacacaagactacccccagtttggggaggtggtccttctagtgaatatgcctgcagacagccctgcagatgaagggcagcacctgcctgatgggaggacagctacccccaccagcaccttcacccagcaggacatcaatgaaggcatcgtatggtacaggcactcaggagccccagcccagagcgactccttccgcttcgaggtgtccagtgcctccaatgcccagacccgcctggagagccacatgttcaacatcgcgatcttaccacagacacctgaagcacctaaagtgtctctggaagcatctctccatatgactgctagagaagatggcctgactgttattcagcctcattccctctccttcataaactctgagaagccaagtggaaagattgtctacaacatcactctacctctgcatccaaatcaaggtatcatcgagcaccgggaccaccctcactctcctatccggtatttcacgcaagaggatattaaccagggcaaagtcatgtaccgccctcccccggcagcaccccacctccaggagctcatggccttctcgttcgctggtctcccagaatcagtgaaattccacttcacagtttcagatggagaacacacaagtccggagatggtcctcaccattcacttacttcccagtgatcagcaactgccagtgttccaggtcacagctccacggctggcggtcagcccaggaggcagcacttctgtaggacttcaggtggtagtaagagatgctgagacagcgcccaaagaactcttctttgagcttcggagacctccacagcatggtgtgcttcttaagcatacagctgagttccgaaggccgatggccacaggtgacactttcacctatgaggatgttgagaaaaatgctctacagtatatacatgatggttcctctacccgggaagacagcatggagatctcagtcacagatggcctcacagtgacaatgctggaggtgagagtagaggtgtccctgtcagaagaccgagggcctcgactggctgctggctcctctctgagcattactgttgccagtaaaagcacagccataatcactaggtcacaccttgcttacgtggatgattcttcccccgacccagagatctggattcagttaaattatctgccctcatatggtactctcttaagaatctcaggatctgaggtggaagagctctcagaagtttccaatttcacaatggaagacatcaataacaagaaaatcagatactcagctgtgtttgaaactgatggtcatctggttactgatagcttctatttctctgtctctgacatggaccacaaccatctggataatcagatatttaccatcatgatcactcctgctgaaaatccacctccagtcattgcttttgctgaccttatcacggttgatgagggagggagagcaccactctcatttcaccatttttttgctactgatgatgatgacaacctccagagagatgccatcattaaactaagtgctctgcccaaatatggctgcattgagaacacaggaacaggtgatcgttttggccctgaaactgccagtgacctagaggcatcatttcctattcaagacgtcctggaaaactacatttactactttcagagtgttcatgaaagcattgagccaacccatgatatttttagtttttatgtgagtgatggaaccagtcgttcagaaattcacagcatcaatatcaccattgaggtaaagactttggaagttggaaaggttgagcccttgaccacaatatttcacaccattagagagctttctttatagggactcaaaagcaaagaagattggatttgaccttcaaaattgaaggtcgttcttaaaatatagccttcaggaatcttgtagaattaaggttggcatttggggaaggcttgagttagaaatctaaatttccatttcaggattgaatttatttgttcggtgtgaaaaacagtttgtgaaggtcagagatgctttgccagtctcatatataaatgaaaacttacatatgtctatgtttctctgaaattgtgtttggttctatatgcatatttgccttttcttattttactgcatttatttatttaattgtaacatcaaagaaatgtgttccttgatgctgtatttattctcatttgagcaactacacaggcttgctctaccgagagagagacacaggggaggggaaagataaatctcagaatgaaataccctctgccttgggaaaataaaatgtaaagaaccctctgcactcttaagggtcagtggtggaaaggggctggcaccagggcagggagacagctttagagacccacactttcaaatatagtgtccttctacaggtactgtggtatgcttagcattttctaagagagttctgagttatattagtatggtcttttatcttcaaagtatgttaatacttgtacttgtcaaagcacatatccatatttttggtctagaaaatatggtcattgtacttacggaagatatctgagaaaacttttatgaaatgtccatcagcttcttttgaagggggcattttgttgcctggac

SEQ ID NO: 7690 - DNA, 15624 bp, Homo sapiens
  ENST00000512123
aactttaaaaagctgcttcggacaaaccagagccaggatttccactgtcggggacccgggatcggaagggtctagcccgagggaaatgctggaagatcccatcggccagtgaccagcaactttccggcgagattttgacgcggagaactgtgctctgcctcctcttattctcccaaagctcacgttggcgtcctgccttgcgggggaactcggcgcgctctctgcctgagcagcgagtgaattgaaccccagcccgctccggcgcctccgggctgatgagtgtcgctctccgcccgtccatctctttttcccggaggtaaaggcccgcggtcccccaccttcagtgcgcccgggttccaagcgccggagccagcgttttggcggagccgcttcttggatgctgaaggctgggctcctccatcgtgggtgccgaggcggcgatgggtgtcctcaaagtgtggctcgggctggccctagcgttggcggaatttgcagtattgcctcatcattccgaaggtgcttgtgtctatcaggattccttgttggcggatgccacaatttggaagcccgattcatgccagagctgccgttgccatggtgatattgttatctgcaaacctgctgtttgcagaaaccctcaatgtgcctttgagaagggagaagtgcttcaaatagctgccaaccaatgctgtcctgagtgtgttttgaggactccaggatcttgccatcatgaaaagaaaatccatgagcatgggacagaatgggcctcttctccatgtagtgtgtgctcttgcaatcatggggaagtccgatgtaccccccaaccatgcccaccgctgtcatgtggacaccaggagctggcattcatccctgaaggaagctgctgcccagtttgtgtgggccttgggaaaccctgttcctatgaaggccatgtgtttcaggatggggaggactggcggctgagccggtgtgccaaatgtctgtgtagaaatggggttgcccagtgcttcacagctcagtgtcagcctctattttgtaaccaggatgagactgtagtccgagtccctggaaaatgttgcccgcagtgctctgcaagatcctgctctgcagctggccaagtatacgagcatggtgagcagtggagcgaaaatgcctgcaccacgtgtatatgtgaccggggtgaggtcaggtgtcacaagcaggcctgcctgcccctgagatgcggaaagggtcagagcagggctcggcgtcatgggcaatgctgtgaggaatgtgtgtctcctgccgggagctgctcctatgatggagttgtgcggtaccaggacgaaatgtggaagggctcggcctgtgagttctgcatgtgtgatcatggccaagtgacctgccagactggagagtgtgccaaagtggagtgtgcccgggatgaagaattaattcacttagatggaaagtgttgtcctgaatgcatttcaaggaatggttattgtgtttatgaagaaactggagaatttatgtcatcaaatgctagtgaagttaaacgtattccagagggagagaagtgggaagatggcccttgcaaggtgtgtgagtgccgaggggctcaggtaacttgctacgagccctcttgcccaccatgtccagtgggcacactggccttagaggtgaagggacagtgctgtccagactgcacatcagttcattgccatccagattgtttgacatgctctcagtctccagaccactgtgacctctgccaagatcctaccaagttactgcagaatggatggtgtgtgcacagctgtggactgggtttttaccaagctggcagtctctgtttagcctgccagccccagtgctccacgtgtaccagtgggctggagtgctcatcctgccagcctcccctgctgatgcggcacgggcagtgtgtgcctacctgtggggacggcttctaccaagatcgccattcctgtgcagtctgccatgagtcctgtgcaggttgctggggcccaacggagaagcactgcttggcctgcagagatcccctccacgtgctgagagatggcggctgtgagagcagctgtggaaaaggcttctacaacaggcagggcacctgtagcgcttgtgaccaatcctgtgacagttgtggccccagtagccccaggtgtcttacctgtactgagaagacagtgctgcatgatgggaaatgcatgtctgaatgccctggcgggtactatgctgatgccactggcaggtgcaaagtttgtcataactcatgtgccagctgctctgggcccacaccctctcactgtacagcctgcagcccccccaaggctctgcgtcaaggccactgtctgccccgctgtggagagggtttctactctgaccatggagtctgcaaagcctgtcactcctcctgcctggcttgtatgggtcccgcaccctctcactgtactgggtgtaagaagccagaggaaggactgcaagtggagcagctgtctgacgtgggcatcccctctggcgagtgtctagcccagtgtagagcccatttttacttggagagcactggcatatgtgaagcttgccaccagtcctgtttcagatgtgcagggaaaagcccacataactgcacagactgtgggccttcccatgtgctgttggatgggcagtgcctctcccagtgcccagatggctactttcaccaggaaggtagttgcacagagtgtcacccaacctgcaggcagtgtcatgggccgttggagtctgactgcatctcctgttaccctcacatctctcttaccaatggtaactgcaggaccagctgcagggaagagcagttcctcaacctcgtgggatactgtgctgactgccatcacctgtgccagcactgtgcagctgatctccacaacactgggagcatctgcctcaggtgccagaatgcccactacctgctgctcggggaccactgtgttcctgactgcccttcaggatactatgcagagagaggagcttgtaaaaaatgccactcctcctgcagaacctgccagggcagaggacctttctcctgctcctcatgtgacaccaacctcgtgctgtcccacactggcacctgcagcaccacctgcttccctgggcactatcttgatgacaatcatgtttgccagccatgcaacacacactgtggaagctgtgattcacaggccagctgtacctcctgccgagatccaaacaaggttctgctctttggggaatgtcaatacgagagctgcgccccacagtactatcttgacttctccaccaacacgtgcaaagagtgtgattggagctgcagtgcatgcagtgggcccctgaaaacagactgcctgcagtgcatggatggctatgttctccaggatggggcctgcgtggagcagtgcttgtcatcattttaccaggactcgggcctctgcaagaactgtgacagctactgtctccagtgccaaggtccccatgagtgtacccgctgcaaagggccatttctcctcttggaagcccagtgtgtccaggaatgtgggaaggggtactttgcagatcatgcaaagcacaaatgcacagcctgccctcaggggtgcttgcagtgcagccacagggaccgttgtcacctctgtgaccatgggttctttctgaagagtggcctctgtgtttacaactgtgttcctggcttttctgtccacacctctaatgaaacatgttctggcaaaatacacacccctagtcttcatgtgaatggttccctgatcctcccaattggttcaataaagccactggatttttccctcctgaatgtccaagaccaggagggtagggtcgaagatctcctatttcatgttgtgagcactcccaccaatggtcagctagtgctctcaagaaatggaaaagaggttcagctggacaaggctggccgttttagctggaaagatgtgaacgagaagaaagtgcgttttgtgcacagcaaagaaaaactcaggaaaggttaccttttcctgaaaattagtgaccagcagttcttctctgagccacagctgatcaacatacaagcattttcaacacaggccccctatgtgctgagaaatgaagttctccacattagcagaggagagagggcaaccatcaccacccagatgcttgacatccgagatgatgacaacccacaggatgtggtcattgaaataatcgatcctccacttcatggccaattgcttcagacacttcagtccccggcaacccctatctatcaattccagctggatgaactctctagaggccttctccactatgctcatgatggttcagacagcacatccgatgttgcagtcttgcaggccaatgatggacactccttccataatatactgttccaagtgaagaccgtgcctcagaatgacaggggtcttcagcttgtggctaattcgatggtgtgggttccagaaggggggatgctgcagatcaccaacagaatcttacaggccgaggctcctggtgccagtgctgaagaaatcatctacaagattacacaagactacccccagtttggggaggtggtccttctagtgaatatgcctgcagacagccctgcagatgaagggcagcacctgcctgatgggaggacagctacccccaccagcaccttcacccagcaggacatcaatgaaggcatcgtatggtacaggcactcaggagccccagcccagagcgactccttccgcttcgaggtgtccagtgcctccaatgcccagacccgcctggagagccacatgttcaacatcgcgatcttaccacagacacctgaagcacctaaagtgtctctggaagcatctctccatatgactgctagagaagatggcctgactgttattcagcctcattccctctccttcataaactctgagaagccaagtggaaagattgtctacaacatcactctacctctgcatccaaatcaaggtatcatcgagcaccgggaccaccctcactctcctatccggtatttcacgcaagaggatattaaccagggcaaagtcatgtaccgccctcccccggcagcaccccacctccaggagctcatggccttctcgttcgctggtctcccagaatcagtgaaattccacttcacagtttcagatggagaacacacaagtccggagatggtcctcaccattcacttacttcccagtgatcagcaactgccagtgttccaggtcacagctccacggctggcggtcagcccaggaggcagcacttctgtaggacttcaggtggtagtaagagatgctgagacagcgcccaaagaactcttctttgagcttcggagacctccacagcatggtgtgcttcttaagcatacagctgagttccgaaggccgatggccacaggtgacactttcacctatgaggatgttgagaaaaatgctctacagtatatacatgatggttcctctacccgggaagacagcatggagatctcagtcacagatggcctcacagtgacaatgctggaggtgagagtagaggtgtccctgtcagaagaccgagggcctcgactggctgctggctcctctctgagcattactgttgccagtaaaagcacagccataatcactaggtcacaccttgcttacgtggatgattcttcccccgacccagagatctggattcagttaaattatctgccctcatatggtactctcttaagaatctcaggatctgaggtggaagagctctcagaagtttccaatttcacaatggaagacatcaataacaagaaaatcagatactcagctgtgtttgaaactgatggtcatctggttactgatagcttctatttctctgtctctgacatggaccacaaccatctggataatcagatatttaccatcatgatcactcctgctgaaaatccacctccagtcattgcttttgctgaccttatcacggttgatgagggagggagagcaccactctcatttcaccatttttttgctactgatgatgatgacaacctccagagagatgccatcattaaactaagtgctctgcccaaatatggctgcattgagaacacaggaacaggtgatcgttttggccctgaaactgccagtgacctagaggcatcatttcctattcaagacgtcctggaaaactacatttactactttcagagtgttcatgaaagcattgagccaacccatgatatttttagtttttatgtgagtgatggaaccagtcgttcagaaattcacagcatcaatatcaccattgagaggaagaacgatgagcctcccaggatgaccttgcagcccctcagagtgcagctgagctcgggagtggtgataagcaattcttctttgagcctgcaagacctggacaccccagataatgagctcatttttgtattgacaaaaaagcctgaccacggtcatgtactctggaggcaaactgcttctgagcctctggagaatgggagagttttagtccagggctcaaccttcacctaccaggatatcctagctgggctggttgggtatgtgcctagtgtccctggcatggtcgtggatgagttccagttctccctcactgatggcctccacgtggacacagggaggatgaagatctacacagaactgcctgcaagtgacacacctcacttggctataaaccaaggcctacagctctcagcagggtctgtagcacgcatcacagaacagcacttgaaagtgacagatattgactcagatgaccatcaggttatgtacatcatgaaggaagatcctggtgcagggcgcctgcagatgatgaagcatggcaacctggagcaaatttctattaaaggccccatccgaagtttcacccaggcagacattagccaaggccacgtagaatatagtcatggaacaggagaacctggagggagctttgcttttaaatttgatgtggttgatggagaaggcaacagattgattgacaagtcattttccatcagcattctagaagacaaatccccaccagtcatcaccaccaataaaggactggtcttggatgaaaactcagtgaagaaaatcaccaccctgcagctgtctgccactgaccaggacagtgggcctacagaattgatctacagaatcaccagacagccccagctgggccacttggaacatgcagcatcaccaggtatccagattagttcctttactcaagctgatctgacttcacgaaatgttcagtatgtccattctagtgaggctgagaaacattcagatgccttcagctttacactgtctgatggagtcagtgaggtgactcagactttccatatcactcttcaccctgtcgatgattcgctgcccgtcgtacagaacttaggaatgcgggtgcaggagggcatgaggaagaccatcacagagtttgagcttaaggcggtggatgctgacacagaggccgagtctgtcacattcaccatcgtgcagcctccacgccatggcaccatcgagcgaaccagcaatgggcagcatttccacctcacctccaccttcaccatgaaagatatctaccagaaccgggtcagctacagccatgacggcagtaactccctcaaggaccggttcaccttcactgtttctgatgggacaaaccccttctttatcattgaggaagggggaaaagagattatgacagcagcacctcagccgttccgagtagacatcctcccggtagatgatggcacgcctagaattgtcaccaacctgggactccagtggctggaatacatggatggcaaggcaaccaacctgatcaccaagaaggaactgctgaccatggacccagacaccgaggacgcgcagcttgtctatgagataacgacgggccctaagcatggctttgtggagaacaagctgcagcctggcagagctgctgccactttcacccaggaggatgtgaacttggggttgattcgttatgtgttgcacaaggagaagatccgtgagatgatggatagttttcagtttctggtgaaagacagtaaacccaatgtggtcagcgacaatgtcttccatatccagtggtcactcatcagctttaaatataccagctacaatgtcagtgagaaggcagggtctgtcagtgtcacggtgcagaggactgggaacctgaaccaatatgccatcgtcctgtgtcgcaccgagcaaggcaccgccagctccagctccagggtcagctcccaacctgggcaacaggactatgtagagtatgctggccaggtccagtttgatgagcgagaggacaccaagtcctgcaccattgtcatcaacgatgatgacgtgtttgaaaatgttgagagtttcactgtggagctcagcatgccagcttatgccctgttaggggaattcacccaggcgaaggtcattatcaacgataccgaggatgaacccacattagagtttgacaagaagatctactgggttaacgagagcgctggttttctgtttgcacctattgaaagaaaaggagatgcaagcagcattgtatctgcaatttgctacacagtccctaagtcagctatgggaagtagcctctatgctctagaatcaggctctgattttaaatctagagggatgtctgccgcgagtcgtgtgatattcgggcctggtgtgaccatgtccacctgtgatgtcatgcttattgatgacagcgagtatgaagaggaagaagagtttgagattgccttggcagatgcctctgacaatgcccgcattggaagggtggcgacagccaaggtgctcattagtggtcccaacgatgcctcgactgtgtccctgggcaacacggctttcactgtcagtgaggacgcaggcacagtaaagattccagttatccgccatggtactgacctctctactttcgcatctgtctggtgtgcaacgcggccctcagacccagcttctgccacaccaggagttgactacgttcccagctctcggaaggtggaatttgggcctggtgtcattgaacagtattgcaccttgactatcttggatgacactcagtatccggtaattgaaggactggagacatttgtggttttcctcagctcagcacaaggagccgaactgaccaaacccttccaggcagtcattgcaattaatgacacattccaagatgtgcccagcatgcagtttgccaaggatttgctcctagtgaaggagaaggagggtgtcctgcatgtccctatcactcggagcggagacctgagctatgagtcatcagtgaggtgctatactcagagccattccgctcaggtcatggaggactttgaggagagacaaaatgcagactcttcacggattacatttctcaaaggggacaaagtgaagaactgtacggtctatatccacgatgactccatgtttgagccagaggaacagttcagggtctacctcggccttcctcttggaaaccactggagtggagctagaattggaaagaataacatggccaccatcaccatatccaatgatgaagatgcccccaccattgagtttgaagaagctgcataccaagtccgggaacccgcaggcccagatgccattgcgattctgaacatcaaggtgatccgcagaggggatcagaacaggacctccaaggttcgctgcagcacgcgggatggctctgcccagtctggtgtggattattacccaaagagccgagtcttgaagttcagtcccggtgtggatcatatcttttttaaagttgagatcctgtccaatgaagaccgggaatggcatgaatctttctcactagtccttggcccagatgacccagtggaagcagttcttggggatgtgactactgccacggtgacaattctagaccaggaggcagcagggagcctcatattgccagcaccacccattgtggtcacacttgctgactatgaccatgtggaagaagttaccaaggaaggagtcaagaaatccccctccccaggctacccactggtctgtgtcaccccctgcgaccctcatttccccagatacgctgtcatgaaggagcgctgcagtgaggccggcatcaaccagacatctgtgcagttcagctgggaagtggctgcccccactgatggcaatggggcccggtctccctttgaaaccatcactgacaacacaccattcaccagtgtcaaccacatggtcctggacagcatttacttcagccggaggttccatgtgcgttgtgtggccaaggctgtggacaaggtgggccatgtggggacccccttaaggagcaacattgttaccattggaacagacagtgctatctgccacacaccagtggtggctgggacatccagaggcttccaggctcagtccttcatcgcaaccttgaaatacctggatgtcaaacataaggagcatccgaacagaatccacatttcggtgcagatcccacaccaggatggaatgctgccccttatctccaccatgccgttgcacaacttacattttctactgtctgagtccatctacagacaccagcacgtctgctccaatttagttaccacctatgacctgagaggcatctcagaggcagggttcctggatgatgtggtctatgatagcactgccctggggcctggctacgatcgccccttccagtttgaccccagcgtgcgagagccgaagaccatccagctctacaaacacctgaacctgaagagctgcgtgtggacctttgatgcttattatgacatgactgagctgattgacgtctgtgggggctctgtaaccgctgacttccaggtgagggactctgcccagtccttcttgacagtgcacgtgcctctatatgtgtcctacatctatgtgacagcccccaggggctgggcctccttggagcaccacaccgagatggagttttctttcttctatgacactgttctctggagaacaggaatccagacagacagcgtgctctctgcaaggcttcagataataagaatctacattcgagaggatggccgtcttgtcattgaattcaagacccatgccaaattcagaggacagtttgtgatggagcatcacactctcccagaagtgaaatctttcgtattgactccagaccacctaggaggaattgaatttgacttgcagctattatggagcgctcagacttttgattctccacatcaactctggagagccacaagctcttataacaggaaggactactcaggagagtacaccatctacctgatcccttgcacagtgcagcccacacagccatgggttgacccaggagagaagcctttggcctgcactgcacatgccccagaaagattcctgatacccattgcattccagcagaccaaccgccctgtgccagttgtgtattcacttaacactgaatttcagctctgcaataatgagaaggtgttcctaatggatcccaatacatctgatatgtcactagcagaaatggattacaaaggagccttttcaaaaggtcaaatcctttatggccgagtactttggaatccagaacaaaatcttaattctgcttacaaactccagctggagaaagtctatctttgtacgggcaaggatggttatgtgcctttctttgatcccacggggacaatctacaatgaagggccccagtatggatgcattcagccaaacaaacacctaaaacacagattcctgctgttggaccgcaatcagccagaggtaactgataagtacttccatgatgtgccttttgaggctcactttgcctctgagttgcctgatttccatgtggtcagtaacatgccaggtgtggatggatttactctaaaagtagatgcactctataaggtggaagcaggacaccagtggtatctccaggtcatctacatcattggccctgacaccatctcagggccccgggtccagcgctctctcacagctccactcagacgcaaccgaagggacctggtagagcccgatggccagctgatccttgatgattccctcatctatgacaatgaaggagaccaagtcaagaatggcaccaatatgaagtccctgaatctggagatgcaagagttggcggtagctgcgtccctgtcacagactggggcgtccattggcagtgccctggctgcaatcatgcttctacttctggtgtttttggtggcttgttttatcaacaggaaatgccagaaacagaggaagaagaagcccgcagaggacattttggaagaatatcctctgaataccaaggtagaagtgcccaagaggcacccggaccgggtggagaagaacgtgaatagacactactgcactgtgcggaacgtcaacatcctgagtgagcctgaggcggcttacacgttcaaaggtgctaaagtcaaaagactgaatctagaagtcagagttcacaacaatttacaagatggaacagaagtttaatggaggagacctatgtgtatttttttctaaaatcatttttataaaatggggggaaatactggtatttttataatctcgcagataaaaaagggaaaactatagctttgagtggcagacagcacacatcacatgcatcaactcacaactgagctacctcattcagcaaagaaccactgagaaccccagagtattacagttatttccgtagatccctttaatagtgtcaacaactgtacacagctccttctgtaaggctggtcttagaaaacaagtactttagtatcaggacaggagttgaacaattaggttagcagatggagatgagaggactgggtagagtaccatggcagatctcagagagaagaagtaggtacgggcctttggttccctcccccagccccagctttctcctacagggcttttcctgagtccccagacagcagagtatgaactgctgacacccagattccattaaaaattctgctaatcgacacaacacatatatttgctcatgatttcacttgacagcgtatgctccttggcctctaattgtactttgcttttccagagccctttttacctggggatttcagtgtgcttaagtaaaatcctctgaaaaccacgggagcctctgcctcctcagccacagagaactccctcctacaaagggggagactgaaacccgagttaaggaggggcctggcaggcgtatcagagcacattagtgatgcccttcaccccagggaggtgtctgttcccaactagtttatgtggcactgagacatccatccctgaccaaggatgctgcgaaacaggatcaatgtactacggccttttaattcaacattgccataaatgctttaaagaaaacccaccacactttcctcctactccggtctttgcccgttcctgtaacagacaatcccatgtcctaggtatggttttttattctgttagtgcttcgggaaagtaagtgattcatttgaataaggcaaattaggagaaagcccaggttggggtgaaatcagacttaacagatacatgctggttctccttgctgtgtgtgacacagcagacagaggcactattcctggtgcagtatttcagggatttctctttgaggggttcttttctggtagctcaggcaattatttttaccatatcagcacatgacaaggccatgaacacatggctctaaaataatttagtgttcaagtatcagcttaactattttgtgtaggctacacacagcttgcttttgtttctcttctgtttctgccttattggcggaaacataagcgtgcatgccatgttgttttgaattggaggcacaatttcattattcgagagtaaaagacatgtcctcttctgatgcatggcacaccatagtcaccaagcaaataacagagccttcacattgtgtaatatttgtatgagaatgactcaagctctttgagaacattccaaactagtaacatttcgctactaaaagctagaaaggatgaactgtgaaaggttctaggcagctctgtgagactccaagctccttgaaagtaggacctttgtgagccacgcctttcattcttcaacagtgccttgcatgtaacaagcactccagaaatgtttgttgaatgaatgaatggtgtcatgggtgaatgatggggagtaaatttaggaaggggaagtgagagagtatggtggcaatatcacaagggaggagagaggaaaacaattatcttctctacttggattatgagataaccttttcttggaggaaagaaacaccgctttacaaaggcatgactctggcggtggtcctaaggaagcatgagcagaaaattcataaaaatgtatcatcagcaggagatgagactatgaattggcatccagaacaggagatttagagcaaaatctaatttagcattctgagatgagtgtcaggttttcaggagagaatgagttggggtgagcccagagtctgaaactcctgactggtcaggtgctacttaagaccagcttgggcaattcagggcagaactcctgtatcagcctcatggacacccagaattggtatctcatggctggagagctgatcagccaggcacagaatctccagaacaacctagagagtgaatgctaatttgtagagcgaacttccatttggcccattatttgtaactgtgtaactgctccaagtgccagaatgcttacacgttaaagcagcacctttccatttgcccacatattcttcttgcacaccccttccattactgctgaataggacattgcatgggaagagtacagaggtggcagaatgaagctagagtgggaaggactaaagactgagccccagagtgctcccagcaaccgccacgtacaaggtctgaaatgacaagggcaagagtgagataggaaactgtgtgtgaaaggaaagcccttgcagtatttctgcctccctttctttctgcctttcaccccactaaatgtatgttattgaatgccagtacttctctagtggatgcacacttgttaaatagtgttaagagatgtggagatgagatatacccctttgatgtagaattattcatttggtttgtttcatacttcattataggaatcaagtaatttgatgactaatgtggattatatttcagtcaaagctctgctttcaatttctctgatttgctcactaatgccttgtgtgtgttttactaaccttttatatcttgccttcaagtgagaaggaacaaacaactctcagtggttactacttgcttttatatgctggctgtgaaggttaaaagaaagaatggtctgtaccattctgctttgctgcccttttattgtaccccaggcctcctagaggactcctgcagattctattgttgggtgggaaatagtgttggaatgtgtttgcacagtcttatgatattcagtctcagtctgctataggtatttgttattcttggatactacacacctgctcagactgagtaaacatttgtggtgctgtcaacctgatttcttgactctcaaatgatttttgtatttccaatatgaatttgtgtgttatgaatttctgatttctccaatagtatatgccactatataaatttgtattaataaatgacagtcttgttggttt

SEQ ID NO: 7691 - DNA, 2297 bp, Homo sapiens
  ENST00000508909
aggatttccactgtcggggacccgggatcggaagggtctagcccgagggaaatgctggaagatcccatcggccagtgaccagcaactttccggcgagattttgacgcggagaactgtgctctgcctcctcttattctcccaaagctcacgttggcgtcctgccttgcgggggaactcggcgcgctctctgcctgagcagcgagtgaattgaaccccagcccgctccggcgcctccgggctgatgagtgtcgctctccgcccgtccatctctttttcccggaggtaaaggcccgcggtcccccaccttcagtgcgcccgggttccaagcgccggagccagcgttttggcggagccgcttcttggatgctgaaggctgggctcctccatcgtgggtgccgaggcggcgatgggtgtcctcaaagtgtggctcgggctggccctagcgttggcggaatttgcagtattgcctcatcattccgaaggtgcttgtgtctatcaggattccttgttggcggaaggtggatgagccattggaggtgccagagaggaggaatggcaacactggacttatcatctaattaaactgctgaaatgagagtgtgcttgtttccagggaaactatattaaatactttaaaaagactccatagggagtaagaaatgaccagaagggactaaaaataacttgaaaaacactgaataatctattttggggtgtgtttcttactccataatacccatgcacccctgggctcacaagactttctctaaagtcagcccttgtggaacacagcgtgactgttaaatcaggaatccatcagagggaaactacctaggtaataggtttaactgtgatgtccagtgtgaggaggaaaattaatttttcatttcaaagttttcacacaccttctgttcttttccaactatatcaagtattgaaaaaactctccttttgcatcaccacaagcaaacacatatccttttgaaagttcttcctgggatcaatgacttgactcttcacttcaatttttctgtctgtgaaatggagatgaactatttacttctcaggactgttgtgaagcttaaaggagatgaacatgaagcaactcgtccagtgctgtgacttacagtgctcaataaaggttggctgctattattgttgttctatagcagtgacgactggcaaggttggataaatgactcttcttccctggatcaaaagtgttaagtgttgggattttcctacttgggatacttttgctgagaaatgctgacaaagtgaatcacaaggcactaactcttagcaaatttgaaagaatatttttcaaggataatttaaaaatgtggaatgttgactatatataacactgcaggaaaatccaggctttggagtttgaatcttggcaccactacatacatgctgtgtggtctcagatataatactttatacagccaggtgtcactttcattatctacttaattgggattatatttctcctaggtttgatgtgacagttaactgagaacatacttgtgaaagaacccagaactgtccctgcaaggaacacgtactcacatcattcaggtggtaacaagatgtcggagtagaaatgagtgagttatagagtccagggtcttggttcaggttctggccctgtaattactagctgtatagcttggagtaagtcacttgaatgaaatgaggtctcagtttctaaattagtaaattaagagagttaggttagcttttctccaagattccttagcccagtatcgtgtagtagagctttctgtgatgatgggaatgttccatagctgtgctgtccagtgtggtagctacgagccacatgtggttattgagtacttgaagtgtggctgacgatactgaggaactgaattttaaatttcacttaatgtcaatgaattaaagtttaaatttgagtagccacatatagatagtggctactatattggacagtgcaacattagagttttaaaattcttaacgtactctagtacttaaaatacagcctcatgaatggttctcaccctgggtggaagcttactggagtacttttagcagttgtgagaaaagtaatacaaagtttgttatagtacctaagtttgctgtttttgtttgtttatataatttgaacagttttgaagtcaacacagttacaacactactctctccatattgctaaatatgttttcttttttgttgtcgtggttttttttttaaaccaagcaattgttatggatcaatgctttcttgaataaaagaaaaggagtaaaatt

SEQ ID NO: 7692 - DNA, 2217 bp, Homo sapiens
  ENST00000502446
agggagaagtgcttcaaatagctgccaaccaatgctgtcctgagtgtgttttgaggactccaggatcttgccatcatgaaaagaaaatccatgagcatgggacagaatgggcctcttctccatgtagtgtgtgctcttgcaatcatggggaagtccgatgtaccccccaaccatgcccaccgctgtcatgtggacaccaggagctggcattcatccctgaaggaagctgctgcccagtttgtgtgggccttgggaaaccctgttcctatgaaggccatgtgtttcaggatggggaggactggcggctgagccggtgtgccaaatgtctgtgtagaaatggggttgcccagtgcttcacagctcagtgtcagcctctattttgtaaccaggatgagactgtagtccgagtccctggaaaatgttgcccgcagtgctctgcaagatcctgctctgcagctggccaagtatacgagcatggtgagcagtggagcgaaaatgcctgcaccacgtgtatatgtgaccggggtgaggtcaggtgtcacaagcaggcctgcctgcccctgagatgcggaaagggtcagagcagggctcggcgtcatgggcaatgctgtgaggaatgtgtgtctcctgccgggagctgctcctatgatggagttgtgcggtaccaggacgaaatgtggaagggctcggcctgtgagttctgcatgtgtgatcatggccaagtgacctgccagactggagagtgtgccaaagtggagtgtgcccgggatgaagaattaattcacttagatggaaagtgttgtcctgaatgcatttcaaggaatggttattgtgtttatgaagaaactggagaatttatgtcatcaaatgctagtgaagttaaacgtattccagagggagagaagtgggaagatggcccttgcaaggtgtgtgagtgccgaggggctcaggtaacttgctacgagccctcttgcccaccatgtccagtgggcacactggccttagaggtgaagggacagtgctgtccagactgcacatcagttcattgccatccagattgtttgacatgctctcagtctccagaccactgtgacctctgccaagatcctaccaagttactgcagaatggatggtgtgtgcacagctgtggactgggtttttaccaagctggcagtctctgtttagcctgccagccccagtgctccacgtgtaccagtgggctggagtgctcatcctgccagcctcccctgctgatgcggcacgggcagtgtgtgcctacctgtggggacggcttctaccaagatcgccattcctgtgcagtctgccatgagtcctgtgcaggttgctggggcccaacggagaagcactgcttggcctgcagagatcccctccacgtgctgagagatggcggctgtgagagcagctgtggaaaaggcttctacaacaggcagggcacctgtagcgcttgtgaccaatcctgtgacagttgtggccccagtagccccaggtgtcttacctgtactgagaagacagtgctgcatgatgggaaatgcatgtctgaatgccctggcgggtactatgctgatgccactggcaggtgcaaagtttgtcataactcatgtgccagctgctctgggcccacaccctctcactgtacagcctgcagcccccccaaggctctgcgtcaaggccactgtctgccccgctgtggagagggtttctactctgaccatggagtctgcaaagcctgtcactcctcctgcctggcttgtatgggtcccgcaccctctcactgtactgggtgtaagaagccagaggaaggactgcaagtggagcagctgtctgacgtgggcatcccctctggcgagtgtctagcccagtgtagagcccatttttacttggagagcactggcatatgtgaagggcaaaatctggacttctgtcagaatttagaagtgatttctgctgtttgccttggcatatcatctacagagaattgatgacatcctgaataaataatttgactcaatagccaggccatctatgagtggttgaggagatgaaagggaagtattatagtttcctttctgttcccacaagtagccttgctgttgggtgaatagtttgactctaaagctacgtgaaaaaaaaatcattagtttgtatttttcattgtaaacatatgttcattaaaaaaattttataatacacccacta

SEQ ID NO: 7693 - DNA, 2169 bp, Homo sapiens
  ENST00000508900
ctgttcctatgaaggccatgtgtttcaggatggggaggactggcggctgagccggtgtgccaaatgtctgtgtagaaatggggttgcccagtgcttcacagctcagtgtcagcctctattttgtaaccaggatgagactgtagtccgagtccctggaaaatgttgcccgcagtgctctgcaagatcctgctctgcagctggccaagtatacgagcatggtgagcagtggagcgaaaatgcctgcaccacgtgtatatgtgaccggggtgaggtcaggtgtcacaagcaggcctgcctgcccctgagatgcggaaagggtcagagcagggctcggcgtcatgggcaatgctgtgaggaatgtgtgtctcctgccgggagctgctcctatgatggagttgtgcggtaccaggacgaaatgtggaagggctcggcctgtgagttctgcatgtgtgatcatggccaagtgacctgccagactggagagtgtgccaaagtggagtgtgcccgggatgaagaattaattcacttagatggaaagtgttgtcctgaatgcatttcaaggaatggttattgtgtttatgaagaaactggagaatttatgtcatcaaatgctagtgaagttaaacgtattccagagggagagaagtgggaagatggcccttgcaaggtgtgtgagtgccgaggggctcaggtaacttgctacgagccctcttgcccaccatgtccagtgggcacactggccttagaggtgaagggacagtgctgtccagactgcacatcagttcattgccatccagattgtttgacatgctctcagtctccagaccactgtgacctctgccaagatcctaccaagttactgcagaatggatggtgtgtgcacagctgtggactgggtttttaccaagctggcagtctctgtttagcctgccagccccagtgctccacgtgtaccagtgggctggagtgctcatcctgccagcctcccctgctgatgcggcacgggcagtgtgtgcctacctgtggggacggcttctaccaagatcgccattcctgtgcagtctgccatgagtcctgtgcaggttgctggggcccaacggagaagcactgcttggcctgcagagatcccctccacgtgctgagagatggcggctgtgagagcagctgtggaaaaggcttctacaacaggcagggcacctgtagcgcttgtgaccaatcctgtgacagttgtggccccagtagccccaggtgtcttacctgtactgagaagacagtgctgcatgatgggaaatgcatgtctgaatgccctggcgggtactatgctgatgccactggcaggtgcaaagtttgtcataactcatgtgccagctgctctgggcccacaccctctcactgtacagcctgcagcccccccaaggctctgcgtcaaggccactgtctgccccgctgtggagagggtttctactctgaccatggagtctgcaaagcctgtcactcctcctgcctggcttgtatgggtcccgcaccctctcactgtactgggtgtaagaagccagaggaaggactgcaagtggagcagctgtctgacgtgggcatcccctctggcgagtgtctagcccagtgtagagcccatttttacttggagagcactggcatatgtgaagcttgccaccagtcctgtttcagatgtgcagggaaaagcccacataactgcacagactgtgggccttcccatgtgctgttggatgggcagtgcctctcccagtgcccagatggctactttcaccaggaaggtagttgcacagagtgtcacccaacctgcaggcagtgtcatgggccgttggagtctgactgcatctcctgttaccctcacatctctcttaccaatggtaactgcaggaccagctgcagggaagagcagttcctcaacctcgtgggatactgtgctggtgagtgaaactcctgtggactcctcggaaatcactgggcagctgccggggctcttcataccaggcttaagggggctctttgtcctcagtttatgagctcttttataggagacatttgtttcatgtctggaaactcatgttactgcttctccttgggcatttagtaaatacttgtggatttaaatagaacttctaataatactcttgcaaatcctgaaaa

SEQ ID NO: 7694 - DNA, 2125 bp, Homo sapiens
  ENST00000510944
cactctacctctgcatccaaatcaaggtctcccagaatcagtgaaattccacttcacagtttcagatggagaacacacaagtccggagatggtcctcaccattcacttacttcccagtgatcagcaactgccagtgttccaggtcacagctccacggctggcggtcagcccaggaggcagcacttctgtaggacttcaggtggtagtaagagatgctgagacagcgcccaaagaactcttctttgagcttcggagacctccacagcatggtgtgcttcttaagcatacagctgagttccgaaggccgatggccacaggtgacactttcacctatgaggatgttgagaaaaatgctctacagtatatacatgatggttcctctacccgggaagacagcatggagatctcagtcacagatggcctcacagtgacaatgctggaggtgagagtagaggtgtccctgtcagaagaccgagggcctcgactggctgctggctcctctctgagcattactgttgccagtaaaagcacagccataatcactaggtcacaccttgcttacgtggatgattcttcccccgacccagagatctggattcagttaaattatctgccctcatatggtactctcttaagaatctcaggatctgaggtggaagagctctcagaagtttccaatttcacaatggaagacatcaataacaagaaaatcagatactcagctgtgtttgaaactgatggtcatctggttactgatagcttctatttctctgtctctgacatggaccacaaccatctggataatcagatatttaccatcatgatcactcctgctgaaaatccacctccagtcattgcttttgctgaccttatcacggttgatgagggagggagagcaccactctcatttcaccatttttttgctactgatgatgatgacaacctccagagagatgccatcattaaactaagtgctctgcccaaatatggctgcattgagaacacaggaacaggtgatcgttttggccctgaaactgccagtgacctagaggcatcatttcctattcaagacgtcctggaaaactacatttactactttcagagtgttcatgaaagcattgagccaacccatgatatttttagtttttatgtgagtgatggaaccagtcgttcagaaattcacagcatcaatatcaccattgaggtaaagactttggaagttggaaaggttgagcccttgaccacaatatttcacaccattagagagctttctttatagggactcaaaagcaaagaagattggatttgaccttcaaaattgaaggtcgttcttaaaatatagccttcaggaatcttgtagaattaaggttggcatttggggaaggcttgagttagaaatctaaatttccatttcaggattgaatttatttgttcggtgtgaaaaacagtttgtgaaggtcagagatgctttgccagtctcatatataaatgaaaacttacatatgtctatgtttctctgaaattgtgtttggttctatatgcatatttgccttttcttattttactgcatttatttatttaattgtaacatcaaagaaatgtgttccttgatgctgtatttattctcatttgagcaactacacaggcttgctctaccgagagagagacacaggggaggggaaagataaatctcagaatgaaataccctctgccttgggaaaataaaatgtaaagaaccctctgcactcttaagggtcagtggtggaaaggggctggcaccagggcagggagacagctttagagacccacactttcaaatatagtgtccttctacaggtactgtggtatgcttagcattttctaagagagttctgagttatattagtatggtcttttatcttcaaagtatgttaatacttgtacttgtcaaagcacatatccatatttttggtctagaaaatatggtcattgtacttacggaagatatctgagaaaacttttatgaaatgtccatcagcttcttttgaagggggcattttgttgcctggacttgctctcttttcaaactaactattttgcttgggaagtaaagatggtgccacattaaatgctattttgaggtgaa

SEQ ID NO: 7695 - DNA, 564 bp, Homo sapiens
  ENST00000509802
gtactctggaggcaaactgcttctgagcctctggagaatgggagagttttagtccagggctcaaccttcacctaccaggatatcctagctgggctggttgggtatgtgcctagtgtccctggcatggtcgtggatgagttccagttctccctcactgatggcctccacgtggacacagggaggatgaagatctacacagaactgcctgcaagtgacacacctcacttggctataaaccaaggcctacagctctcagcagggtctgtagcacgcatcacagaacagcacttgaaagtgacagatattgactcagatgaccatcaggttatgtacatcatgaaggaagatcctggtgcagggcgcctgcagatgatgaagcatggcaacctggagcaaatttctattaaaggccccatccgaagtttcacccaggcagacattagccaaggtcagccagttctcttctgcctaccaggcttccgtggactgcacctacactagtaaaatgagaattaaatatctggtagtctatggcaataaactgtgcactctttgttttgagga

SEQ ID NO: 7696 - DNA, 2481 bp, Homo sapiens
  ENST00000380894
agtctgcagggaggaaagtcagaattagatattcaagatggccgcctctgatggagtccctggcactcactcaagcttgcatttggtagatggtgacacaagaatccatgctgaaggctgccttgcctctctttaccagattcatcatcagcaatggactgcggaccgagcacggggtgtttgagatcacactggagactgtggacagagccctgcctgtggtaaccaggaacaaggggttgagactggcccaaggggccgtgggcctgctttcccctgacctccttcagctgaccgaccctgatacacctgcggagaacctcaccttcctcttggttcagctcccccagcatggccagctctacctgtgggggacagggctacttcaacacaatttcacccagcaggatgtggacagcaagaatgtggcctatcggcactcaggaggggactcccagactgactgctttactttcatggccacagatgggacaaaccaaggctttattgtgaatgggagagtgtgggaagaacctgttttattcaccattcaggtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccaggaatgtcaactaagatgtggaatatagcaattacctatgacggattagaggaagatgatgaggtctttgaagtaattctgaactcccctgtgaatgcagttcttggcacaaagacaaaagctgcagtgaaaattttggactcaaaaggaggacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaaatataacagaccctacagggggccacctggagtttgtcacctatttattcacaggatctgtgaatattgctccatagaaaacaaattgttatgattgagtgggtatacctttgtgattctgtctagtgaaaatgggacatttttaatagtgccagaaagattgataaataaatattttttacaagataagatacaatttttgtatctcaataccttttaaaataaatgccagcagtattataaa

SEQ ID NO: 7697 - DNA, 6126 bp, Homo sapiens
  ENST00000380875
acacaaaaagccttacaaatggaagaactaaggtggtacttaaaaacagcaccttaggatctagttccatcctatcttttcccttaaatgccatgacaaaagttaaaacgggccctgtcccttctgaatgctgggcttctcatctaaatttaaataaaaacctttgaagatgggaatgtgttggaagaaaagaagggcagaaaaaaagtgtgttggaagagtctgtggagtcctgaggcttggcgctcaggaagtttgcaaagctgcagcagctgccttggagaagaccagcaaagaaagtggagtgtgtatgtgaacttcaattctgtattttctgtgaggtgggttaatggatttttagtaaaaagaaatctcaaacacagctgacctgaaagactggaatttcagctctcttccttcccggggttctttttcctcccccttcctctcaaagccctttaaaccagattgctgtgtcagtgactcttatcctgcccgccagttccaagggtttctaactttttgtcttggaaaggaaaaccactacctgattagaaaagcacttgggaagcccattaatcttgccggcgttgtcaggagtgatcagcgagttttattaaaagccctgggattgcctgaaaggcccccttgtctgactttgaaatgaaaggggcatgttaagatctcggggcacattgtcaggacccctcaccctgccccttggactatgagctgaccctccaggaggaagcacagaagccctcctttgttaaagggatttcgccggtggacagagaagagttgggccctgtcagcatgaactctctgagttggggggctgcgaatgccgtgctgctgctgctcctcctggcctgggccagccccaccttcatcagcatcaaccgcggggtgagggtgatgaagggccactctgccttcctgtcaggagatgacctgaagtttgccatccctaaagagaaagatgcctgcaaagtggaagttgtgatgaatgagccaataacccagagggttgggaaactcactccacaggtctttgactgccatttccttcccaacgaagtcaagtatgttcacaatggttgtccaattcttgatgaagacacagtgaagctcagactttacagatttactgaaagagataccttcatagaaacttttatcctgtgggtctatctcctggaaccagactgtaacatcatccatatgagtaacaatgtgctggaggtgcctgaattcaatggcttgtcccaagcgattgataaaaatctgctcagattcgattatgataggatggctagcctggaatgtaccgtcagcctggacactgcgagaactcggctgccagcccatggccagatggttctcggggagcctcgaccagaagaacctcgtggagatcagccacacagttttttcccagagtcccaactgagagcaaaactgaagtgtccaggtgggagctgtaccccaggattaaagaaaataggaagcctcaaagtgagctgtgaggagttcctgctgatgggccttcgttatcagcatctggatcccccttcacccaacattgattatatctccatccaactggacctcacagataccaggagcaaaattgtgtacaagtcagagagtgcgtggctgcctgtctatatcagagctggaattccgaatcagattccaaaggctgcattcatggccgtgtttattctggaagtggatcagttcatcctgacctccttgactacatcagttctggactgtgaagaagatgagacccctaaacccttgctggtgttcaacattactaaagccccgctccagggctatgtgactcacctgttggatcacaccagaccaatctcctcattcacctggaaagatctcagtgacatgcagatcgcctatcagccaccaaacagcagccattctgagaggagacatgatgaggtagaattggaggtatacgacttcttctttgaaaggagtgcacctatgacagtccacatctccatcagaacagcagatacaaatgccccccgtgtatcctggaatacaggtctgagtctccttgaggggcagtctcgagccatcacttgggaacagtttcaggttgtcgacaatgacgacattggtgctgtccggctagtcaccgttggtggcctgcagcatggatggctgactttaagaggggggaaagggtttctcttcaccgtggctgacctccaggctggagttgttcgctatcatcatgatgacagcgactccaccaaagacttcgtggtcttccggatatttgatggccatcacagcatccgtcacaaattccccatcaacgtcttgcccaaagatgatagtcccccgttcctcataaccaatgttgtgattgaactggaggaggggcagaccatcctgatccagggatccatgctgcgagcttcagatgtggacgccagtgatgactacatcttcttcaatatcacaaagcctccacaggctggggagatcatgaagaagccagggccaggactgataggctatcctgtccatggcttccttcagagggatttgtttaatggaatcatttattatcgtcattttggtggagaaatctttgaagattcttttcaatttgtcctgtgggacagccatgaacctccaaatctttcagtgccacaggtggcaacaatccatataactccagtggatgaccagcttccaaaagaggctcctggagtttctcggcatttggttgtcaaggaaactgaggtggcctatataactaagaaacagctacattttatagattcagaatcatatgacagggagctggtctacacaataactactcctccatttttctccttcagccacagacacttggatgctgggaaattatttatggtggacagcataccaaaagtagttaagaatcctacggccctggagctgaggtcattcactcagcatgctgtgaactatatgaaagtggcctacatgccccccatgcaagacattggtccccattgcagagatgtccagttcacattttctgtcagtaaccaacatggcggtactttgcatgggatctgctttaacattacaatcctcccagtggacaatcaagttcctgaggcgttcaccaaccctctgaaagtgactgagggaggtcaaagcatcatcagcacagagcacattctaatttctgatgcagataccaagctggacaatattgacctctccctgcgggaattgcctctgcacggaagggtggagctgaatggatttcctctaaattcagggggcacattttcttggggcgatctccataccttaaaagttaggtatcaacatgatggaactgaagttcttcaggatgacctactcttggaggtcaccgatggcacaaattcagcagaatttgtactacatgttgaggtattccctgtcaacgatgagccaccagtcttaaaggctgacctcatgcctgtcatgaattgctcagagggaggagaggtggtcatcacctctgaatacatttttgctactgatgtggacagcgataacttgaagttgatgtttgtgattgctcgcgaacctcagcatggggtggtgaggagagctggagtcacagtggatcagttctctcagagagatgttatctcagaggccgtgacatacaaacacacaggtggcgagattggcctgatgccttgttttgacaccattacattggtggtttcggatggagaggctggcccttttgtgaatggctgttgctacaatggacccaatccatctgttccacttcatgcgtcctttccagtgtatgatctcaacatcacggtatacccagtagacaaccagccaccttccattgcaataggtcccgtgtttgttgtagatgagggctgctcaacagcccttactgttaaccatttgtccgccactgaccctgacactgcagcagatgacttggaatttgttttggtttctcctcctcagtttggctacctcgaaaatatactcccttctgtgggttttgaaaaaagcaatattggcataagtatagattcatttcagtggaaagacatgaacgcttttcacattaactatgtgcagtccaggcatctgaggatagaaccaactgccgaccagttcacggtgtacgtcacagatgggaagcatcactccttggagataccattttctattataatcaaccccacaaatgatgaagctcctgactttgtagtgcagaatattactgtgtgtgagggtcagatgaaagagctggactcttccatcatcagcgctgtggacctggacattccccaggatgccctgctgttcagcatcactcaaaagccacgccatggcctcctcatcgatagggggtttagcaaagacttctctgagaataagcagccagccaaccctcaccagaaacatgcacctgttcacagcttttccatggaactcctcaagactggaatgaggttgacgtacatgcatgatgactcagagagccttgctgatgattttacaatccaattgtcagatgggaaacataagatacttaaaaccatttcagtagaggtcatcccagttaatgatgaaaaaccaatgctgagcaagaaggctgaaattgcaatgaatatgggtgaaactcgtattatttccagtgctattctttcagccatagatgaagactcacccagggagaagatttactatgtatttgaaaggcttccccaaaatgggcaacttcagcttaaggaatgtcaactaagatgtggaatatagcaattacctatgacggattagaggaagatgatgaggtctttgaagtaattctgaactcccctgtgaatgcagttcttggcacaaagacaaaagctgcagtgaaaattttggactcaaaaggaggacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaaatataacagaccctacagggggccacctggagtttgtcacctatttattcacaggatctgtgaatattgctccatagaaaacaaattgttatgattgagtgggtatacctttgtgattctgtctagtgaaaatgggacatttttaatagtgccagaaagattgataaataaatattttttacaagataagatacaa

SEQ ID NO: 7698 - DNA, 1421 bp, Homo sapiens
  ENST00000427623
gatgctggatgagtccttggcagtcaggaggtccaaaaaatgcaaagaaatgataatgcactgggagaagaaagaagatattgacatcgtgaacacagtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccaggttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaaatataacagaccctacagggggccacctgg

SEQ ID NO: 7699 - DNA, 7324 bp, Homo sapiens
  ENST00000380880
ttagtacaaaactagtagtgagaaaggaagctgggaagagactgggaagaggcaaccgacctcattaacaaaagctcagttttgtccctgcggacccaaccagcagaaggcacggggctagcggtggctgtccgccagggaggtcgggctctgtgtaaacagtagaaggcatctttatcatgcccttctcacagggagtcctgaggcttggcgctcaggaagtttgcaaagctgcagcagctgccttggagaagaccagcaaagaaagtggagtgtgtatgtgaacttcaattctgtattttctgtgaggtgggttaatggatttttagtaaaaagaaatctcaaacacagctgacctgaaagactggaatttcagctctcttccttcccggggttctttttcctcccccttcctctcaaagccctttaaaccagattgctgtgtcagtgactcttatcctgcccgccagttccaagggtttctaactttttgtcttggaaaggaaaaccactacctgattagaaaagcacttgggaagcccattaatcttgccggcgttgtcaggagtgatcagcgagttttattaaaagccctgggattgcctgaaaggcccccttgtctgactttgaaatgaaaggggcatgttaagatctcggggcacattgtcaggacccctcaccctgccccttggactatgagctgaccctccaggaggaagcacagaagccctcctttgttaaagggatttcgccggtggacagagaagagttgggccctgtcagcatgaactctctgagttggggggctgcgaatgccgtgctgctgctgctcctcctggcctgggccagccccaccttcatcagcatcaaccgcggggtgagggtgatgaagggccactctgccttcctgtcaggagatgacctgaagtttgccatccctaaagagaaagatgcctgcaaagtggaagttgtgatgaatgagccaataacccagagggttgggaaactcactccacaggtctttgactgccatttccttcccaacgaagtcaagtatgttcacaatggttgtccaattcttgatgaagacacagtgaagctcagactttacagatttactgaaagagataccttcatagaaacttttatcctgtgggtctatctcctggaaccagactgtaacatcatccatatgagtaacaatgtgctggaggtgcctgaattcaatggcttgtcccaagcgattgataaaaatctgctcagattcgattatgataggatggctagcctggaatgtaccgtcagcctggacactgcgagaactcggctgccagcccatggccagatggttctcggggagcctcgaccagaagaacctcgtggagatcagccacacagttttttcccagagtcccaactgagagcaaaactgaagtgtccaggtgggagctgtaccccaggattaaagaaaataggaagcctcaaagtgagctgtgaggagttcctgctgatgggccttcgttatcagcatctggatcccccttcacccaacattgattatatctccatccaactggacctcacagataccaggagcaaaattgtgtacaagtcagagagtgcgtggctgcctgtctatatcagagctggaattccgaatcagattccaaaggctgcattcatggccgtgtttattctggaagtggatcagttcatcctgacctccttgactacatcagttctggactgtgaagaagatgagacccctaaacccttgctggtgttcaacattactaaagccccgctccagggctatgtgactcacctgttggatcacaccagaccaatctcctcattcacctggaaagatctcagtgacatgcagatcgcctatcagccaccaaacagcagccattctgagaggagacatgatgaggtagaattggaggtatacgacttcttctttgaaaggagtgcacctatgacagtccacatctccatcagaacagcagatacaaatgccccccgtgtatcctggaatacaggtctgagtctccttgaggggcagtctcgagccatcacttgggaacagtttcaggttgtcgacaatgacgacattggtgctgtccggctagtcaccgttggtggcctgcagcatggatggctgactttaagaggggggaaagggtttctcttcaccgtggctgacctccaggctggagttgttcgctatcatcatgatgacagcgactccaccaaagacttcgtggtcttccggatatttgatggccatcacagcatccgtcacaaattccccatcaacgtcttgcccaaagatgatagtcccccgttcctcataaccaatgttgtgattgaactggaggaggggcagaccatcctgatccagggatccatgctgcgagcttcagatgtggacgccagtgatgactacatcttcttcaatatcacaaagcctccacaggctggggagatcatgaagaagccagggccaggactgataggctatcctgtccatggcttccttcagagggatttgtttaatggaatcatttattatcgtcattttggtggagaaatctttgaagattcttttcaatttgtcctgtgggacagccatgaacctccaaatctttcagtgccacaggtggcaacaatccatataactccagtggatgaccagcttccaaaagaggctcctggagtttctcggcatttggttgtcaaggaaactgaggtggcctatataactaagaaacagctacattttatagattcagaatcatatgacagggagctggtctacacaataactactcctccatttttctccttcagccacagacacttggatgctgggaaattatttatggtggacagcataccaaaagtagttaagaatcctacggccctggagctgaggtcattcactcagcatgctgtgaactatatgaaagtggcctacatgccccccatgcaagacattggtccccattgcagagatgtccagttcacattttctgtcagtaaccaacatggcggtactttgcatgggatctgctttaacattacaatcctcccagtggacaatcaagttcctgaggcgttcaccaaccctctgaaagtgactgagggaggtcaaagcatcatcagcacagagcacattctaatttctgatgcagataccaagctggacaatattgacctctccctgcgggaattgcctctgcacggaagggtggagctgaatggatttcctctaaattcagggggcacattttcttggggcgatctccataccttaaaagttaggtatcaacatgatggaactgaagttcttcaggatgacctactcttggaggtcaccgatggcacaaattcagcagaatttgtactacatgttgaggtattccctgtcaacgatgagccaccagtcttaaaggctgacctcatgcctgtcatgaattgctcagagggaggagaggtggtcatcacctctgaatacatttttgctactgatgtggacagcgataacttgaagttgatgtttgtgattgctcgcgaacctcagcatggggtggtgaggagagctggagtcacagtggatcagttctctcagagagatgttatctcagaggccgtgacatacaaacacacaggtggcgagattggcctgatgccttgttttgacaccattacattggtggtttcggatggagaggctggcccttttgtgaatggctgttgctacaatggacccaatccatctgttccacttcatgcgtcctttccagtgtatgatctcaacatcacggtatacccagtagacaaccagccaccttccattgcaataggtcccgtgtttgttgtagatgagggctgctcaacagcccttactgttaaccatttgtccgccactgaccctgacactgcagcagatgacttggaatttgttttggtttctcctcctcagtttggctacctcgaaaatatactcccttctgtgggttttgaaaaaagcaatattggcataagtatagattcatttcagtggaaagacatgaacgcttttcacattaactatgtgcagtccaggcatctgaggatagaaccaactgccgaccagttcacggtgtacgtcacagatgggaagcatcactccttggagataccattttctattataatcaaccccacaaatgatgaagctcctgactttgtagtgcagaatattactgtgtgtgagggtcagatgaaagagctggactcttccatcatcagcgctgtggacctggacattccccaggatgccctgctgttcagcatcactcaaaagccacgccatggcctcctcatcgatagggggtttagcaaagacttctctgagaataagcagccagccaaccctcaccagaaacatgcacctgttcacagcttttccatggaactcctcaagactggaatgaggttgacgtacatgcatgatgactcagagagccttgctgatgattttacaatccaattgtcagatgggaaacataagatacttaaaaccatttcagtagaggtcatcccagttaatgatgaaaaaccaatgctgagcaagaaggctgaaattgcaatgaatatgggtgaaactcgtattatttccagtgctattctttcagccatagatgaagactcacccagggagaagatttactatgtatttgaaaggcttccccaaaatgggcaacttcagcttaagatagggagggactgggttcctctctcccctggcatgaaatgcactcaggaggaagtggatctgaacttgctgagatacacacacaccggggcaatggattcccagaatcaagatagcttcaccttctacctttgggatggcaacaacaggtcccctgctcttgactgtcaaatcaccatcaaggacatggaaaaaggtgatattgtcatccttacaaaaccactcgtggtgtctaaaggtgatagaggtttcttaacaaccaccacgctcctggctgtggacggaacagacaagcctgaggaactgctctatgtcatcacctcccctccgcgatatggccagatcgaatatgttcactatcctggagttcccattacaaacttcagccaaatggatgtagtggggcagacagtttgctatgtacacaagagcaaggtgactgtctccagtgacagattcagattcatcatcagcaatggactgcggaccgagcacggggtgtttgagatcacactggagactgtggacagagccctgcctgtggtaaccaggaacaaggggttgagactggcccaaggggccgtgggcctgctttcccctgacctccttcagctgaccgaccctgatacacctgcggagaacctcaccttcctcttggttcagctcccccagcatggccagctctacctgtgggggacagggctacttcaacacaatttcacccagcaggatgtggacagcaagaatgtggcctatcggcactcaggaggggactcccagactgactgctttactttcatggccacagatgggacaaaccaaggctttattgtgaatgggagagtgtgggaagaacctgttttattcaccattcaggtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccaggaatgtcaactaagatgtggaatatagcaattacctatgacggattagaggaagatgatgaggtctttgaagtaattctgaactcccctgtgaatgcagttcttggcacaaagacaaaagctgcagtgaaaattttggactcaaaaggaggacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaa

SEQ ID NO: 7700 - DNA, 815 bp, Homo sapiens
  ENST00000486223
cactcaggaggggactcccagactgactgctttactttcatggccacagatgggacaaaccaaggctttattgtgaatgggagagtgtgggaagaacctgttttattcaccattcaggtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccagccagccaaaagtagaagaagtggatagcttcacctttccattgacttctgttgaggattgaagagactgattagatcatgagatctatgtgaggcataccttcaagaaagaggccaccatatagatggacagttgagaggtataagtc

SEQ ID NO: 7701 - DNA, 699 bp, Homo sapiens
  ENST00000485068
gtgatattgtcatccttacaaaaccactcgtggtgtctaaaggtgatagaggtttcttaacaaccaccacgctcctggctgtggacggaacagacaagcctgaggaactgctctatgtcatcacctcccctccgcgatatggccagatcgaatatgttcactatcctggagttcccattacaaacttcagccaaatggatgtagtggggcagacagtttgctatgtacacaagagcaaggtgactgtctccagtgacagattcagtagatggtgacacaagaatccatgctgaaggctgccttgcctctctttaccagattcatcatcagcaatggactgcggaccgagcacggggtgtttgagatcacactggagactgtggacagagccctgcctgtggtaaccaggaacaaggggttgagactggcccaaggggccgtgggcctgctttcccctgacctccttcagctgaccgaccctgatacacctgcggagaacctcaccttcctcttggttcagctcccccagcatggccagctctacctgtgggggacagggctacttcaacacaatttcacccagcaggatgtggacagcaagaatgtggcctatcggcactcaggaggggactcccagactgactgctttactttcatggccacagatgggacaaaccaaggctttattgtgaatgggag

SEQ ID NO: 7702 - DNA, 741 bp, Homo sapiens
  ENST00000466679
gggagaagatttactatgtatttgaaaggcttccccaaaatgggcaacttcagcttaaggaggaagtggatctgaacttgctgagatacacacacaccggggcaatggattcccagaatcaagatagcttcaccttctacctttgggatggcaacaacaggtcccctgctcttgactgtcaaatcaccatcaaggacatggaaaaaggtgatattgtcatccttacaaaaccactcgtggtgtctaaaggtgatagaggtttcttaacaaccaccacgctcctggctgtggacggaacagacaagcctgaggaactgctctatgtcatcacctcccctccgcgatatggccagatcgaatatgttcactatcctggagttcccattacaaacttcagccaaatggatgtagtggggcagacagtttgctatgtacacaagagcaaggtgactgtctccagtgacagattcagattcatcatcagcaatggactgcggaccgagcacggggtgtttgagatcacactggagactgtggacagagccctgcctgtggtaaccaggaacaaggggttgagactggcccaaggggccgtgggcctgctttcccctgacctccttcagctgaccgaccctgatacacctgcggagaacctcaccttcctcttggttcagctcccccagcatggccagctctacctgtgggggacagggctacttcaacacaatttcacccagcagg

SEQ ID NO: 7703 - DNA, 701 bp, Homo sapiens
  ENST00000497634
gaaggctgaaattgcaatgaatatgggtgaaactcgtattatttccagtgctattctttcagccatagatgaagactcacccagggagaagatttactatgtatttgaaaggcttccccaaaatgggcaacttcagcttaagatagggagggactgggttcctctctcccctggcatgaaatgcactcaggaggaagtggatctgaacttgctgagatacacacacaccggggcaatggattcccagaatcaagatagcttcaccttctacctttgggatggcaacaacaggtcccctgctcttgactgtcaaatcaccatcaaggacatggaaaaaggtgatattgtcatccttacaaaaccactcgtggtgtctaaaggtgatagaggtttcttaacaaccaccacgctcctggctgtggacggaacagacaagcctgaggaactgctctatgtcatcacctcccctccgcgatatggccagatcgaatatgttcactatcctggagttcccattacaaacttcagccaaatggatgtagtggggcagacagtttgctatgtacacaagagcaaggtgactgtctccagtgacagattcaggtgagccccatggaaacttttcaaaccccttctttggattaatacttacagaaaaggagatctgttaatgtgcttcactatagtaaccatttcacaaa

SEQ ID NO: 7704 - DNA, 10086 bp, Homo sapiens
  ENST00000422223
acacaaaaagccttacaaatggaagaactaaggtggtacttaaaaacagcaccttaggatctagttccatcctatcttttcccttaaatgccatgacaaaagttaaaacgggccctgtcccttctgaatgctgggcttctcatctaaatttaaataaaaacctttgaagatgggaatgtgttggaagaaaagaagggcagaaaaaaagtgtgttggaagagtctgtggagtcctgaggcttggcgctcaggaagtttgcaaagctgcagcagctgccttggagaagaccagcaaagaaagtggagtgtgtatgtgaacttcaattctgtattttctgtgaggtgggttaatggatttttagtaaaaagaaatctcaaacacagctgacctgaaagactggaatttcagctctcttccttcccggggttctttttcctcccccttcctctcaaagccctttaaaccagattgctgtgtcagtgactcttatcctgcccgccagttccaagggtttctaactttttgtcttggaaaggaaaaccactacctgattagaaaagcacttgggaagcccattaatcttgccggcgttgtcaggagtgatcagcgagttttattaaaagccctgggattgcctgaaaggcccccttgtctgactttgaaatgaaaggggcatgttaagatctcggggcacattgtcaggacccctcaccctgccccttggactatgagctgaccctccaggaggaagcacagaagccctcctttgttaaagggatttcgccggtggacagagaagagttgggccctgtcagcatgaactctctgagttggggggctgcgaatgccgtgctgctgctgctcctcctggcctgggccagccccaccttcatcagcatcaaccgcggggtgagggtgatgaagggccactctgccttcctgtcaggagatgacctgaagtttgccatccctaaagagaaagatgcctgcaaagtggaagttgtgatgaatgagccaataacccagagggttgggaaactcactccacaggtctttgactgccatttccttcccaacgaagtcaagtatgttcacaatggttgtccaattcttgatgaagacacagtgaagctcagactttacagatttactgaaagagataccttcatagaaacttttatcctgtgggtctatctcctggaaccagactgtaacatcatccatatgagtaacaatgtgctggaggtgcctgaattcaatggcttgtcccaagcgattgataaaaatctgctcagattcgattatgataggatggctagcctggaatgtaccgtcagcctggacactgcgagaactcggctgccagcccatggccagatggttctcggggagcctcgaccagaagaacctcgtggagatcagccacacagttttttcccagagtcccaactgagagcaaaactgaagtgtccaggtgggagctgtaccccaggattaaagaaaataggaagcctcaaagtgagctgtgaggagttcctgctgatgggccttcgttatcagcatctggatcccccttcacccaacattgattatatctccatccaactggacctcacagataccaggagcaaaattgtgtacaagtcagagagtgcgtggctgcctgtctatatcagagctggaattccgaatcagattccaaaggctgcattcatggccgtgtttattctggaagtggatcagttcatcctgacctccttgactacatcagttctggactgtgaagaagatgagacccctaaacccttgctggtgttcaacattactaaagccccgctccagggctatgtgactcacctgttggatcacaccagaccaatctcctcattcacctggaaagatctcagtgacatgcagatcgcctatcagccaccaaacagcagccattctgagaggagacatgatgaggtagaattggaggtatacgacttcttctttgaaaggagtgcacctatgacagtccacatctccatcagaacagcagatacaaatgccccccgtgtatcctggaatacaggtctgagtctccttgaggggcagtctcgagccatcacttgggaacagtttcaggttgtcgacaatgacgacattggtgctgtccggctagtcaccgttggtggcctgcagcatggatggctgactttaagaggggggaaagggtttctcttcaccgtggctgacctccaggctggagttgttcgctatcatcatgatgacagcgactccaccaaagacttcgtggtcttccggatatttgatggccatcacagcatccgtcacaaattccccatcaacgtcttgcccaaagatgatagtcccccgttcctcataaccaatgttgtgattgaactggaggaggggcagaccatcctgatccagggatccatgctgcgagcttcagatgtggacgccagtgatgactacatcttcttcaatatcacaaagcctccacaggctggggagatcatgaagaagccagggccaggactgataggctatcctgtccatggcttccttcagagggatttgtttaatggaatcatttattatcgtcattttggtggagaaatctttgaagattcttttcaatttgtcctgtgggacagccatgaacctccaaatctttcagtgccacaggtggcaacaatccatataactccagtggatgaccagcttccaaaagaggctcctggagtttctcggcatttggttgtcaaggaaactgaggtggcctatataactaagaaacagctacattttatagattcagaatcatatgacagggagctggtctacacaataactactcctccatttttctccttcagccacagacacttggatgctgggaaattatttatggtggacagcataccaaaagtagttaagaatcctacggccctggagctgaggtcattcactcagcatgctgtgaactatatgaaagtggcctacatgccccccatgcaagacattggtccccattgcagagatgtccagttcacattttctgtcagtaaccaacatggcggtactttgcatgggatctgctttaacattacaatcctcccagtggacaatcaagttcctgaggcgttcaccaaccctctgaaagtgactgagggaggtcaaagcatcatcagcacagagcacattctaatttctgatgcagataccaagctggacaatattgacctctccctgcgggaattgcctctgcacggaagggtggagctgaatggatttcctctaaattcagggggcacattttcttggggcgatctccataccttaaaagttaggtatcaacatgatggaactgaagttcttcaggatgacctactcttggaggtcaccgatggcacaaattcagcagaatttgtactacatgttgaggtattccctgtcaacgatgagccaccagtcttaaaggctgacctcatgcctgtcatgaattgctcagagggaggagaggtggtcatcacctctgaatacatttttgctactgatgtggacagcgataacttgaagttgatgtttgtgattgctcgcgaacctcagcatggggtggtgaggagagctggagtcacagtggatcagttctctcagagagatgttatctcagaggccgtgacatacaaacacacaggtggcgagattggcctgatgccttgttttgacaccattacattggtggtttcggatggagaggctggcccttttgtgaatggctgttgctacaatggacccaatccatctgttccacttcatgcgtcctttccagtgtatgatctcaacatcacggtatacccagtagacaaccagccaccttccattgcaataggtcccgtgtttgttgtagatgagggctgctcaacagcccttactgttaaccatttgtccgccactgaccctgacactgcagcagatgacttggaatttgttttggtttctcctcctcagtttggctacctcgaaaatatactcccttctgtgggttttgaaaaaagcaatattggcataagtatagattcatttcagtggaaagacatgaacgcttttcacattaactatgtgcagtccaggcatctgaggatagaaccaactgccgaccagttcacggtgtacgtcacagatgggaagcatcactccttggagataccattttctattataatcaaccccacaaatgatgaagctcctgactttgtagtgcagaatattactgtgtgtgagggtcagatgaaagagctggactcttccatcatcagcgctgtggacctggacattccccaggatgccctgctgttcagcatcactcaaaagccacgccatggcctcctcatcgatagggggtttagcaaagacttctctgagaataagcagccagccaaccctcaccagaaacatgcacctgttcacagcttttccatggaactcctcaagactggaatgaggttgacgtacatgcatgatgactcagagagccttgctgatgattttacaatccaattgtcagatgggaaacataagatacttaaaaccatttcagtagaggtcatcccagttaatgatgaaaaaccaatgctgagcaagaaggctgaaattgcaatgaatatgggtgaaactcgtattatttccagtgctattctttcagccatagatgaagactcacccagggagaagatttactatgtatttgaaaggcttccccaaaatgggcaacttcagcttaagatagggagggactgggttcctctctcccctggcatgaaatgcactcaggaggaagtggatctgaacttgctgagatacacacacaccggggcaatggattcccagaatcaagatagcttcaccttctacctttgggatggcaacaacaggtcccctgctcttgactgtcaaatcaccatcaaggacatggaaaaaggtgatattgtcatccttacaaaaccactcgtggtgtctaaaggtgatagaggtttcttaacaaccaccacgctcctggctgtggacggaacagacaagcctgaggaactgctctatgtcatcacctcccctccgcgatatggccagatcgaatatgttcactatcctggagttcccattacaaacttcagccaaatggatgtagtggggcagacagtttgctatgtacacaagagcaaggtgactgtctccagtgacagattcagattcatcatcagcaatggactgcggaccgagcacggggtgtttgagatcacactggagactgtggacagagccctgcctgtggtaaccaggaacaaggggttgagactggcccaaggggccgtgggcctgctttcccctgacctccttcagctgaccgaccctgatacacctgcggagaacctcaccttcctcttggttcagctcccccagcatggccagctctacctgtgggggacagggctacttcaacacaatttcacccagcaggatgtggacagcaagaatgtggcctatcggcactcaggaggggactcccagactgactgctttactttcatggccacagatgggacaaaccaaggctttattgtgaatgggagagtgtgggaagaacctgttttattcaccattcaggtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccaggaatgtcaactaagatgtggaatatagcaattacctatgacggattagaggaagatgatgaggtctttgaagtaattctgaactcccctgtgaatgcagttcttggcacaaagacaaaagctgcagtgaaaattttggactcaaaaggaggacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaaatataacagaccctacagggggccacctggagtttgtcacctatttattcacaggatctgtgaatattgctccatagaaaacaaattgttatgattgagtgggtatacctttgtgattctgtctagtgaaaatgggacatttttaatagtgccagaaagattgataaataaatattttttacaagataagatacaatttttgtatctcaataccttttaaaataaatgccagcagtattataaagtgtaaggtttgtttattccagaagaccctcacccttaccccattccaaatctcagggagcaccagtctcatagtccttggatttttttaaaaaaaatttttggtcccgttacctctaatgaatttattctgaaatatgtatcgtaggtgctcctaccactttagtctgagtgaagctaactctactagttcattaaaccaaagttgaaccgcaaagttgtccctttggagccctttaaatgtgaaatctaagattagaggctggggttgaaaaagagaattttctatgatgaaaaagaaagactttagatgaaagaatcttgtaggtggaggctcatctacaaagctgtagttcaggtaagaattcggggggctggctgtactcagagttctactcatcactattcatgaaacagatctccctttccaatttgagtgttggcattgtaccatcccaaagctaatgattgggtttccccagccttacagagtcatgagaaatttcaagtaacataatctgttcctctgtgtttattgtactgacaagcatttctcagggacacttgggataaggagtatatatgaatgatggttgacacatggaagaaaaatactgcttcctcagaaatgtcctgatgaactgtgctgatgaacagagaaaaataataccgaaaacagagcccctgaaagcctacattctcggaaaggattttgaggaattttgagccaccttaaatctttaatatttgcagaaatgccatgttaactagattctctaacggaaaggtaccttattaatttataatctcaggtgagtggaacatttttgtaacaatgaagtatgttgcagcgttaccagaactcccttctgaaatcaaggtttaacagttataggaaattagaatgtctgaaacatttatttaaagtttttctcttttcataatcactgagaaatatggttgtgccaaatgtcacttgctctatgagcaccaatgtaacttcagaatcaaattggggttatcaagtaggctagagctctggtgctggttttattataaaaataccttgagtgttgtagacactaaaactgcttgaagaaagtcagttcagtttctgggatataaaaacatggcaagctttttttatttcagttcatttatcaaggttgtaattaatagaaacatttagaaagagatattggaatatgatccagacattctgtctattacttaaatctaaacataattatagtgtcagagggtccttacctgagatgtcgcaggtgggctccagattggcataatgtacaggttctctgtgagacacaagcagtttctggcatttaaccaaaagatgccacacctatcctcttaccagctcctttcaaattccttctggtccacaggcttcttgcagtatggaaatgtgagatttgggctaaagaaaaaatagttgtttacctaaagggttaagtcctaggaaggaagtagaagtttgggaaatgagggattcaagggccactccttccactggaactctaaaactatataaaccatctaaaactggaaatctagaactatgtcaactgtgtagaaccttgtcagcatggcagatttattatacatttctgcaatataaatgataaatgatactgaactaattgcaaatgttagcataaagagtgttttgatttttataacaattagaaatgctacaagaatatttaaaaatattcctgatcatgaaagcattaatcaaattagaaaatccaagtcattttaagaagataaaaatagaaattcaggcaagtttgggtgatgggcggtattcatcacaaccttcattttattcttacaattgagctttgactcagggggaaaagaagtaaatgattgtcaaggttccctctgccttgattgatagtttctgatgggagtgggaaggaaggaattggagtaatgggtagaatgggaatgagagattacgggagagagagatgagatgggttgaacagaagaggatgggaactgatggtagctaggaaggaaagcgtcaagaaggacctgaatgtacccagcttttctccccaaacttcaataccacctcaggaaaaggcccactgtgtccaggggcgtcagtccagctcaatagtgtctagcttttcagaatcttctgattgtttggtctttaacaaaaacatagcatctatttgctaacaataaacttaagcaacatatgataatcatttcatctccttccaagaagtggtgaaaatgaaccaggtgacattaatttaacttctgtttttgtttatttttaatacaaccaaaaagatatgcacatattttaatttacattatggtactgtataatttaaaccataaactggtgctgattaatttctgcaacaaagcagcatattaaatgtactacatctagtgttgtagcaaaattaataaacttgttttaagttctgagacactttc

SEQ ID NO: 7705 - DNA, 3067 bp, Homo sapiens
  ENST00000283309
gtgatctgggaggtgctgagcacccacctgcgacccatggcgggggagggccgagtaacgacagcatggcggtgcccccgagagggaggggcatagaccccgcccggacaaaccctgacacgttccctccttcaggggcgcgatgtatggaacccagtcctgagaggcctgcatgcagtcagcaggagccgaccctgggaatggacgcgatggcctcggaacacagggatgtcctcgtgctgctgcccagccgggagcaactgcggctggccgtgggggtgaaggctactggccgcgagcttttccagcaagtgtgcaacgtggcgagcatcagagacgcgcagttctttggcctctgtgtggtcagaaacaatgagtatatatttatggatttggagcaaaagctcagcaagtacttctcaaaagattggaagaaagaaagaaatgaaggaaatgagaaacccagagcccccttcgtggccttcctccgagtgcagcactacgtggaaaacggaagggtcataagcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggaggtacttcgagccacactcctacttcccacagtggatcatcaccaagagggggattgactacatcctccggcacatgcctaccctgcaccgtgagcgccagggcctgagccccaaggaggccatgctgtgcttcatccaggaggcctgccggctggaggacgtgcccgtgcacttcttcaggctgcacaaggataagaaggaaggtcgtcccaccgtgatcctgggactggccctcaggggagtgcacatctaccagggaaagaagctggagatccagctggatgggctgcccgcagcacagaagctggtttactacacggggtgcacctggcggtccaggcacctgctgcacctgctgcgcgccagccaccagctccacctccgcgtgcggcccactctgcaacagctgcggcagcgggaggaggcagaagagaagcagcactaccgggagtcctatatcagcgatgagctggagctggacctggccagcaggagcttcccgggcagtggggtcagcagccagcactgcccccactgcctctcacgccactccgccgacagccacggcagttcctacacgtcaggcatcaaggccaactcctggctcagggaatccagagagatgtctgtggacgtgcccttggaggtccacgggctccatgagaaggagccgtcctccagccccaggaccagccgcagccaccccagcacacgtggtgacagccaagccactcgtcaggagccctgcacccaggtcaggaccagaggccagagcgccgaggccgtgcaccagatccaggaaatgacagccggggtcagtgaggagcagcacagccatggcctggacgacatgcagctgcaccagctggccctgcacccagcgcccacctcactcagccataccttccaccgcgccctggactgcaggctggcaggcccctgcgagaccagggccactctccccagcaagaggtccagcaactgtctcgccctggacctgttcggagaggctccaccacaggagtttgtggtgtaggcaccacccacccagcagtaccgtccgcaccgccaggctcagcccctgcccaccccacttccacatggccctcgtcccttcctgcccgccagatgctgcctgcacttccgcagccagcacgctccacaggttcacctgtaagaggtgtggagctggctctgacatcaacctgggaggtaacaaacaggtcccgcacctcatgcctgtctgccatacacccgggagctctttccctcagggtctcagggagccagttcaaggtctggctgtcaagtgtccagagagccatggtgttggcccctgaggcagcctgtcacccatcctaatctgggagagaaggtgacacagctgggcccagaccctggagagacagctctgcagtttcccacactgtcagctccccaagagacagtcctgatgggcacaggctgccagagctcccaagccggagttcacagtcatcactgtgcaggacccaggttcctcccagacctgaacccctctctgcaactcctgtttgcaagcgctgggcctgccagacagaggcccctcttgtggtgcaagcccagctctgtcacctgagatccagccagagaccctcctccaccatccacagtcaatggctgtgctttcccttccaagccagggcttccaaagaccccactgccccggagctgaagccgactctgctcccatctcagccatgaggcctcaggacccactctgctcacaggtggcttccttaagccattgccctggctggggttgggctggtgcagcccagctggcggaggggcgaagctttggtgacagacggagagtgggggactagctgtgcatggcacctgctctgatccggtgggctccacgggtagtgcgacctcggttctgtgggctctggaaggccaccagggtagggtctccccagggctcctccccctgcacaacactcctgcacacgtgcaaacctgctgtcctctgcatttagaggaatggcccgtgcatccctgctagtctcaggcccatcccagagcactgagaggccacaatcgttcagccctgtgccctgaacaccactgcccccttcactgtctgtgtgtggtgaagaccacgccacaccaccctccagctcactggagacaagcatgagcttgagccccatggcctggtgcagggctgcgtgcattgaggccgcctctttgacgggtccatccagggggaccctctcctttctgtgaaagggaatcgtgtgtgtgccccaggcacgtgtaataaagaacccgagcagatgcctcctgcttgaaccaggaccagcctgcctggggggctggtgagatgccggctgtaactca

SEQ ID NO: 7706 - DNA, 2650 bp, Homo sapiens
  ENST00000432403
gctgccttagagcttctagggtaacaaagacgtccctcaggaggatcctgagacttacttccagaacagagcttcagggcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggaggtacttcgagccacactcctacttcccacagtggatcatcaccaagagggggattgactacatcctccggcacatgcctaccctgcaccgtgagcgccagggcctgagccccaaggaggccatgctgtgcttcatccaggaggcctgccggctggaggacgtgcccgtgcacttcttcaggctgcacaaggataagaaggaaggtcgtcccaccgtgatcctgggactggccctcaggggagtgcacatctaccaggaggtggaccgtgctccgcagctgctgtacgacctcccctggccccacgttgggaagctggcatttctgggaaagaagctggagatccagctggatgggctgcccgcagcacagaagctggtttactacacggggtgcacctggcggtccaggcacctgctgcacctgctgcgcgccagccaccagctccacctccgcgtgcggcccactctgcaacagctgcggcagcgggaggaggcagaagagaagcagcactaccgggagtcctatatcagcgatgagctggagctggacctggccagcaggagcttcccgggcagtggggtcagcagccagcactgcccccactgcctctcacgccactccgccgacagccacggcagttcctacacgtcaggcatcaaggccaactcctggctcagggaatccagagagatgtctgtggacgtgcccttggaggtccacgggctccatgagaaggagccgtcctccagccccaggaccagccgcagccaccccagcacacgtggtgacagccaagccactcgtcaggagccctgcacccaggtcaggaccagaggccagagcgccgaggccgtgcaccagatccaggaaatgacagccggggtcagtgaggagcagcacagccatggcctggacgacatgcagctgcaccagctggccctgcacccagcgcccacctcactcagccataccttccaccgcgccctggactgcaggctggcaggcccctgcgagaccagggccactctccccagcaagaggtccagcaactgtctcgccctggacctgttcggagaggctccaccacaggagtttgtggtgtaggcaccacccacccagcagtaccgtccgcaccgccaggctcagcccctgcccaccccacttccacatggccctcgtcccttcctgcccgccagatgctgcctgcacttccgcagccagcacgctccacaggttcacctgtaagaggtgtggagctggctctgacatcaacctgggaggtaacaaacaggtcccgcacctcatgcctgtctgccatacacccgggagctctttccctcagggtctcagggagccagttcaaggtctggctgtcaagtgtccagagagccatggtgttggcccctgaggcagcctgtcacccatcctaatctgggagagaaggtgacacagctgggcccagaccctggagagacagctctgcagtttcccacactgtcagctccccaagagacagtcctgatgggcacaggctgccagagctcccaagccggagttcacagtcatcactgtgcaggacccaggttcctcccagacctgaacccctctctgcaactcctgtttgcaagcgctgggcctgccagacagaggcccctcttgtggtgcaagcccagctctgtcacctgagatccagccagagaccctcctccaccatccacagtcaatggctgtgctttcccttccaagccagggcttccaaagaccccactgccccggagctgaagccgactctgctcccatctcagccatgaggcctcaggacccactctgctcacaggtggcttccttaagccattgccctggctggggttgggctggtgcagcccagctggcggaggggcgaagctttggtgacagacggagagtgggggactagctgtgcatggcacctgctctgatccggtgggctccacgggtagtgcgacctcggttctgtgggctctggaaggccaccagggtagggtctccccagggctcctccccctgcacaacactcctgcacacgtgcaaacctgctgtcctctgcatttagaggaatggcccgtgcatccctgctagtctcaggcccatcccagagcactgagaggccacaatcgttcagccctgtgccctgaacaccactgcccccttcactgtctgtgtgtggtgaagaccacgccacaccaccctccagctcactggagacaagcatgagcttgagccccatggcctggtgcagggctgcgtgcattgaggccgcctctttgacgggtccatccagggggaccctctcctttctgtgaaagggaatcgtgtgtgtgccccaggcacgtgtaataaagaacccgagcagatgcctcctgcttgaaccaggacca

SEQ ID NO: 7707 - DNA, 4677 bp, Homo sapiens
  ENST00000358587
gtcccggaaagcacagctgtgatctgggaggtgctgagcacccacctgcgacccatggcgggggagggccgagggcgcgatgtatggaacccagtcctgagaggcctgcatgcagtcagcaggagccgaccctgggaatggacgcgatggcctcggaacacagggatgtcctcgtgctgctgcccagccgggagcaactgcggctggccgtgggggtgaaggctactggccgcgagcttttccagcaagtgtgcaacgtggcgagcatcagagacgcgcagttctttggcctctgtgtggtcagaaacaatgagtatatatttatggatttggagcaaaagctcagcaagtacttctcaaaagattggaagaaagaaagaaatgaaggaaatgagaaacccagagcccccttcgtggccttcctccgagtgcagcactacgtggaaaacggaagggtcataaggtaacggcatgcggactgtaaggggtgtttcctggaatactgaaaatctgccgcatgacgtggaagtcccctgaaggccacacattacatttgagtttatccaaaaacaaaaaacaaacaaacaaccccactatatcggctgtttgctttggggttaacacaggaattctatttaatcgaaaggtatacagactgtgtcataaattggtacttctttttcttttctttttctttttgttttgttttgttttgttttgagacggagtttcactcttgtcgcccaggctggagtgcaatggcacaatctcgactcactgcaacctccacctcctgggttcaagcgattcttctgccttagtctccagagtagctgggattacaggcgggcgccaccacacctggctaattttgtattttcagtagagacggggtttctctgtgttggtcaagctggtctcaaactcccgacctcaggtgatccacccgcctcgacctcccaaagtgctgggattacaggtgtgagccaccgtgcccggcctaaagtggtacttcctcaaatgccaggactcgtactctctagggtgggtataccatccgggggtgggcgaggcttctggaggtcgctgggctaagggctgctatgcttgctgcgtggcggttctcgctgttcactgcccactctgcaggtgtctagtgggaagctttccccgacaggagtgggtaagttgtacatctggtgggctgcactctaaaccaacgggggctgcttcttccagagctgccttagagcttctagggtaacaaagacgtccctcaggaggatcctgagacttacttccagaacagagcttcaggggtgcgtgaacagggtttaccctgggggaaaacctaagggggtttcccaggaattccctaagcaggcacaatccctgccagttccaaaaggcatgtgtgcggttgtgtggaaggttctagggggtgaggggcgtgtggttgtgtgggagggttctggagagtgaaaggtgtgtggttgtgtggagagccctggagacactggtatgtggttgtgtggcaggttctggagagtgaggggtgtgtgaatatgtggaaggttctggatagccttggaggggaggtctggaaagtgttgggttgatggatggagctacctggtgctatggggccagttcgggggaattatatgagaagatcttgcacctgcatcttgggcgagcctccacctggcctgtgattaatgaataccagccatggccaagccccgtgctgggcggtgagctctgggagccaggtctgtccacatccagggattcaagttgtccaggccctgtgcacctccagggattcgagtcgcccgggctctgtgcacctctcctgcactggggcttggtttggtgaaggccaagctcactggggaaggagtgggacctcggcaggtggagcctcatctagtggctccttggtggcagcaagtcacctgtgccccgctccaggaagagtgtgggcctgtgccgtgctggccctgcagggacacagctgtgggtataacaagacaggaactaggtaccaggggctcaggacagccctgggagctggtgtggggagggacaaggcagggccagaggggccagcagtccccacaccggtcgtcctggaactcactccctgccaccttccagcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggagatcatcaccaagagggggattgactacatcctccggcacatgcctaccctgcaccgtgagcgccagggcctgagccccaaggaggccatgctgtgcttcatccaggaggcctgccggctggaggacgtgcccgtgcacttcttcaggctgcacaaggataagaaggaaggtcgtcccaccgtgatcctgggactggccctcaggggagtgcacatctaccaggaggtggaccgtgctccgcagctgctgtacgacctcccctggccccacgttgggaagctggcatttctgggaaagaagctggagatccagctggatgggctgcccgcagcacagaagctggtttactacacggggtgcacctggcggtccaggcacctgctgcacctgctgcgcgccagccaccagctccacctccgcgtgcggcccactctgcaacagctgcggcagcgggaggaggcagaagagaagcagcactaccgggagtcctatatcagcgatgagctggagctggacctggccagcaggagcttcccgggcagtggggtcagcagccagcactgcccccactgcctctcacgccactccgccgacagccacggcagttcctacacgtcaggcatcaaggccaactcctggctcagggaatccagagagatgtctgtggacgtgcccttggaggtccacgggctccatgagaaggagccgtcctccagccccaggaccagccgcagccaccccagcacacgtggtgacagccaagccactcgtcaggagccctgcacccaggtcaggaccagaggccagagcgccgaggccgtgcaccagatccaggaaatgacagccggggtcagtgaggagcagcacagccatggcctggacgacatgcagctgcaccagctggccctgcacccagcgcccacctcactcagccataccttccaccgcgccctggactgcaggctggcaggcccctgcgagaccagggccactctccccagcaagaggtccagcaactgtctcgccctggacctgttcggagaggctccaccacaggagtttgtggtgtaggcaccacccacccagcagtaccgtccgcaccgccaggctcagcccctgcccaccccacttccacatggccctcgtcccttcctgcccgccagatgctgcctgcacttccgcagccagcacgctccacaggttcacctgtaagaggtgtggagctggctctgacatcaacctgggaggtaacaaacaggtcccgcacctcatgcctgtctgccatacacccgggagctctttccctcagggtctcagggagccagttcaaggtctggctgtcaagtgtccagagagccatggtgttggcccctgaggcagcctgtcacccatcctaatctgggagagaaggtgacacagctgggcccagaccctggagagacagctctgcagtttcccacactgtcagctccccaagagacagtcctgatgggcacaggctgccagagctcccaagccggagttcacagtcatcactgtgcaggacccaggttcctcccagacctgaacccctctctgcaactcctgtttgcaagcgctgggcctgccagacagaggcccctcttgtggtgcaagcccagctctgtcacctgagatccagccagagaccctcctccaccatccacagtcaatggctgtgctttcccttccaagccagggcttccaaagaccccactgccccggagctgaagccgactctgctcccatctcagccatgaggcctcaggacccactctgctcacaggtggcttccttaagccattgccctggctggggttgggctggtgcagcccagctggcggaggggcgaagctttggtgacagacggagagtgggggactagctgtgcatggcacctgctctgatccggtgggctccacgggtagtgcgacctcggttctgtgggctctggaaggccaccagggtagggtctccccagggctcctccccctgcacaacactcctgcacacgtgcaaacctgctgtcctctgcatttagaggaatggcccgtgcatccctgctagtctcaggcccatcccagagcactgagaggccacaatcgttcagccctgtgccctgaacaccactgcccccttcactgtctgtgtgtggtgaagaccacgccacaccaccctccagctcactggagacaagcatgagcttgagccccatggcctggtgcagggctgcgtgcattgaggccgcctctttgacgggtccatccagggggaccctctcctttctgtgaaagggaatcgtgtgtgtgccccaggcacgtgtaataaagaacccgagcagatgcc

SEQ ID NO: 7708 - DNA, 2857 bp, Homo sapiens
  ENST00000440994
ggaaatgtggacacgggacgccggaaacagggacacgcaccagacgctgggtgtttagaggctgccgtgagaggctcagctgtaggaacactgttgggatcactcgcatcagttgggcgatggatgatgtgaaggctactggccgcgagcttttccagcaagtgtgcaacgtggcgagcatcagagacgcgcagttctttggcctctgtgtggtcagaaacaatgagtatatatttatggatttggagcaaaagctcagcaagtacttctcaaaagattggaagaaagaaagaaatgaaggaaatgagaaacccagagcccccttcgtggccttcctccgagtgcagcactacgtggaaaacggaagggtcataagcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggaggtacttcgagccacactcctacttcccacagtggatcatcaccaagagggggattgactacatcctccggcacatgcctaccctgcaccgtgagcgccagggcctgagccccaaggaggccatgctgtgcttcatccaggaggcctgccggctggaggacgtgcccgtgcacttcttcaggctgcacaaggataagaaggaaggtcgtcccaccgtgatcctgggactggccctcaggggagtgcacatctaccagggaaagaagctggagatccagctggatgggctgcccgcagcacagaagctggtttactacacggggtgcacctggcggtccaggcacctgctgcacctgctgcgcgccagccaccagctccacctccgcgtgcggcccactctgcaacagctgcggcagcgggaggaggcagaagagaagcagcactaccgggagtcctatatcagcgatgagctggagctggacctggccagcaggagcttcccgggcagtggggtcagcagccagcactgcccccactgcctctcacgccactccgccgacagccacggcagttcctacacgtcaggcatcaaggccaactcctggctcagggaatccagagagatgtctgtggacgtgcccttggaggtccacgggctccatgagaaggagccgtcctccagccccaggaccagccgcagccaccccagcacacgtggtgacagccaagccactcgtcaggagccctgcacccaggtcaggaccagaggccagagcgccgaggccgtgcaccagatccaggaaatgacagccggggtcagtgaggagcagcacagccatggcctggacgacatgcagctgcaccagctggccctgcacccagcgcccacctcactcagccataccttccaccgcgccctggactgcaggctggcaggcccctgcgagaccagggccactctccccagcaagaggtccagcaactgtctcgccctggacctgttcggagaggctccaccacaggagtttgtggtgtaggcaccacccacccagcagtaccgtccgcaccgccaggctcagcccctgcccaccccacttccacatggccctcgtcccttcctgcccgccagatgctgcctgcacttccgcagccagcacgctccacaggttcacctgtaagaggtgtggagctggctctgacatcaacctgggaggtaacaaacaggtcccgcacctcatgcctgtctgccatacacccgggagctctttccctcagggtctcagggagccagttcaaggtctggctgtcaagtgtccagagagccatggtgttggcccctgaggcagcctgtcacccatcctaatctgggagagaaggtgacacagctgggcccagaccctggagagacagctctgcagtttcccacactgtcagctccccaagagacagtcctgatgggcacaggctgccagagctcccaagccggagttcacagtcatcactgtgcaggacccaggttcctcccagacctgaacccctctctgcaactcctgtttgcaagcgctgggcctgccagacagaggcccctcttgtggtgcaagcccagctctgtcacctgagatccagccagagaccctcctccaccatccacagtcaatggctgtgctttcccttccaagccagggcttccaaagaccccactgccccggagctgaagccgactctgctcccatctcagccatgaggcctcaggacccactctgctcacaggtggcttccttaagccattgccctggctggggttgggctggtgcagcccagctggcggaggggcgaagctttggtgacagacggagagtgggggactagctgtgcatggcacctgctctgatccggtgggctccacgggtagtgcgacctcggttctgtgggctctggaaggccaccagggtagggtctccccagggctcctccccctgcacaacactcctgcacacgtgcaaacctgctgtcctctgcatttagaggaatggcccgtgcatccctgctagtctcaggcccatcccagagcactgagaggccacaatcgttcagccctgtgccctgaacaccactgcccccttcactgtctgtgtgtggtgaagaccacgccacaccaccctccagctcactggagacaagcatgagcttgagccccatggcctggtgcagggctgcgtgcattgaggccgcctctttgacgggtccatccagggggaccctctcctttctgtgaaagggaatcgtgtgtgtgccccaggcacgtgtaataaagaacccgagcagatgc

SEQ ID NO: 7709 - DNA, 3821 bp, Homo sapiens
  ENST00000468647
agccgtccagaagaagagagagttgggccgaggaggactccagggctcagccatgaggagatctgggcggtggtctcctcttcctcgcggcctctgcccgtccactgcccggccctgacatcacgaacgtggcaggccagcctcttccatcacgaacaggccagtcgagaagacaagacattcagaggggcgcgatgtatggaacccagtcctgagaggcctgcatgcagtcagcaggagccgaccctgggaatggacgcgatggcctcggaacacagggatgtcctcgtgctgctgcccagccgggagcaactgcggctggccgtgggggtgaaggctactggccgcgagcttttccagcaagtgtgcaacgtggcgagcatcagagacgcgcagttctttggcctctgtgtggtcagaaacaatgagtatatatttatggatttggagcaaaagctcagcaagtacttctcaaaagattggaagaaagaaagaaatgaactgctccgtccagaggggctgtccgcagggggactgtggtgagccctgaggctgcaagcaggtgtgcccgcccgaagcccgcctttgcagatgttcttgaacgctgtagaccacgtcccactcagggttctccgggtagaaaataccatgagtcgaattgtcagctatggctgcagacacctgagcttcgactttaagctgagtgtgaagcaatccaggcccccccaactgggaagacaggacagccagcggcacctccctgcggctcacttgctctttcttgcattttccccactagggaaatgagaaacccagagcccccttcgtggccttcctccgagtgcagcactacgtggaaaacggaagggtcataagtagagacggggtttctctgtgttggtcaagctggtctcaaactcccgacctcaggtgatccacccgcctcgacctcccaaagtgctgggattacagagctgccttagagcttctagggtaacaaagacgtccctcaggaggatcctgagacttacttccagaacagagcttcagggcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggaggtacttcgagccacactcctacttcccacagtggatcatcaccaagagggggattgactacatcctccggcacatgcctaccctgcaccgtgagcgccagggcctgagccccaaggaggccatgctgtgcttcatccaggaggcctgccggctggaggacgtgcccgtgcacttcttcaggctgcacaaggataagaaggaaggtcgtcccaccgtgatcctgggactggccctcaggggagtgcacatctaccaggaggtggaccgtgctccgcagctgctgtacgacctcccctggccccacgttgggaagctggcatttctgggaaagaagctggagatccagctggatgggctgcccgcagcacagaagctggtttactacacggggtgcacctggcggtccaggcacctgctgcacctgctgcgcgccagccaccagctccacctccgcgtgcggcccactctgcaacagctgcggcagcgggaggaggcagaagagaagcagcactaccgggagtcctatatcagcgatgagctggagctggacctggccagcaggagcttcccgggcagtggggtcagcagccagcactgcccccactgcctctcacgccactccgccgacagccacggcagttcctacacgtcaggcatcaaggccaactcctggctcagggaatccagagagatgtctgtggacgtgcccttggaggtccacgggctccatgagaaggagccgtcctccagccccaggaccagccgcagccaccccagcacacgtggtgacagccaagccactcgtcaggagccctgcacccaggtcaggaccagaggccagagcgccgaggccgtgcaccagtttcctcccgtataaaataggaggccgttcttgaccactgaggtgcttccagagctagtgttcaaggcccacactcagacctgatcctaaattacaccaaacgctaagagtccaggtccactgagttaaaaggcagaaagcagccccaggaaagaagctgggcaaggtgggggcctcctgaaatgcatcaaaggaagatgccaagcctctctcgcagagatccaggaaatgacagccggggtcagtgaggagcagcacagccatggcctggacgacatgcagctgcaccagctggccctgcacccagcgcccacctcactcagccataccttccaccgcgccctggactgcaggctggcaggcccctgcgagaccagggccactctccccagcaagaggtccagcaactgtctcgccctggacctgttcggagaggctccaccacaggagtttgtggtgtaggcaccacccacccagcagtaccgtccgcaccgccaggctcagcccctgcccaccccacttccacatggccctcgtcccttcctgcccgccagatgctgcctgcacttccgcagccagcacgctccacaggttcacctgtaagaggtgtggagctggctctgacatcaacctgggaggtaacaaacaggtcccgcacctcatgcctgtctgccatacacccgggagctctttccctcagggtctcagggagccagttcaaggtctggctgtcaagtgtccagagagccatggtgttggcccctgaggcagcctgtcacccatcctaatctgggagagaaggtgacacagctgggcccagaccctggagagacagctctgcagtttcccacactgtcagctccccaagagacagtcctgatgggcacaggctgccagagctcccaagccggagttcacagtcatcactgtgcaggacccaggttcctcccagacctgaacccctctctgcaactcctgtttgcaagcgctgggcctgccagacagaggcccctcttgtggtgcaagcccagctctgtcacctgagatccagccagagaccctcctccaccatccacagtcaatggctgtgctttcccttccaagccagggcttccaaagaccccactgccccggagctgaagccgactctgctcccatctcagccatgaggcctcaggacccactctgctcacaggtggcttccttaagccattgccctggctggggttgggctggtgcagcccagctggcggaggggcgaagctttggtgacagacggagagtgggggactagctgtgcatggcacctgctctgatccggtgggctccacgggtagtgcgacctcggttctgtgggctctggaaggccaccagggtagggtctccccagggctcctccccctgcacaacactcctgcacacgtgcaaacctgctgtcctctgcatttagaggaatggcccgtgcatccctgctagtctcaggcccatcccagagcactgagaggccacaatcgttcagccctgtgccctgaacaccactgcccccttcactgtctgtgtgtggtgaagaccacgccacaccaccctccagctcactggagacaagcatgagcttgagccccatggcctggtgcagggctgcgtgcattgaggccgcctctttgacgggtccatccagggggaccctctcctttctgtgaaagggaatcgtgtgtgtgccccaggcacgtgtaataaagaacccgagcagatgc

SEQ ID NO: 7710 - DNA, 2108 bp, Homo sapiens
  ENST00000509157
agccgtccagaagaagagagagttgggccgaggaggactccagggctcagccatgaggagatctgggcggtggtctcctcttcctcgcggcctctgcccgtccactgcccggccctgacatcacgaacgtggcaggccagcctcttccatcacgaacaggccagtcgagaagacaagacattcagaggggcgcgatgtatggaacccagtcctgagaggcctgcatgcagtcagcaggagccgaccctgggaatggacgcgatggcctcggaacacagggatgtcctcgtgctgctgcccagccgggagcaactgcggctggccgtgggggtgaaggctactggccgcgagcttttccagcaagtgtgcaacgtggcgagcatcagagacgcgcagttctttggcctctgtgtggtcagaaacaatgagtatatatttatggatttggagcaaaagctcagcaagtacttctcaaaagattggaagaaagaaagaaatgaactgctccgtccagaggggctgtccgcagggggactgtggtgagccctgaggctgcaagcagggaaatgagaaacccagagcccccttcgtggccttcctccgagtgcagcactacgtggaaaacggaagggtcataagcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggaggtacttcgagccacactcctacttcccacagtggatcatcaccaagagggggattgactacatcctccggcacatgcctaccctgcaccgtgagcgccagggcctgagccccaaggaggccatgctgtgcttcatccaggaggcctgccggctggaggacgtgcccgtgcacttcttcaggctgcacaaggataagaaggaaggtcgtcccaccgtgatcctgggactggccctcaggggagtgcacatctaccagggaaagaagctggagatccagctggatgggctgcccgcagcacagaagctggtttactacacggggtgcacctggcggtccaggcacctgctgcacctgctgcgcgccagccaccagctccacctccgcgtgcggcccactctgcaacagctgcggcagcgggaggaggcagaagagaagcagcactaccgggagtcctatatcagcgatgagctggagctggacctggccagcaggagcttcccgggcagtggggtcagcagccagcactgcccccactgcctctcacgccactccgccgacagccacggcagttcctacacgtcaggcatcaaggccaactcctggctcagggaatccagagagatgtctgtggacgtgcccttggaggtccacgggctccatgagaaggagccgtcctccagccccaggaccagccgcagccaccccagcacacgtggtgacagccaagccactcgtcaggagccctgcacccaggtcaggaccagaggccagagcgccgaggccgtgcaccagatccaggaaatgacagccggggtcagtgaggagcagcacagccatggcctggacgacatgcagctgcaccagctggccctgcacccagcgcccacctcactcagccataccttccaccgcgccctggactgcaggctggcaggcccctgcgagaccagggccactctccccagcaagaggtccagcaactgtctcgccctggacctgttcggagaggctccaccacaggagtttgtggtgtaggcaccacccacccagcagtaccgtccgcaccgccaggctcagcccctgcccaccccacttccacatggccctcgtcccttcctgcccgccagatgctgcctgcacttccgcagccagcacgctccacaggttcacctgtaagaggtgtggagctggctctgacatcaacctgggaggtaacaaacaggtcccgcacctcatgcctgtctgccatacacccgggagctctttccctcagggtctcagggagccagttcaaggtctggctgtcaagtgtcca

SEQ ID NO: 7711 - DNA, 1600 bp, Homo sapiens
  ENST00000336070
acactcagttttgaacacacggtgacacctgagaagcatggtgactgctctgatgaagccttttgttttgctttcagacaatgagtatatatttatggatttggagcaaaagctcagcaagtacttctcaaaagattggaagaaagaaagaaatgaaggaaatgagaaacccagagcccccttcgtggccttcctccgagtgcagcactacgtggaaaacggaagggtcataagcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggaggtacttcgagccacactcctacttcccacagtggatcatcaccaagagggggattgactacatcctccggcacatgcctaccctgcaccgtgagcgccagggcctgagccccaaggaggccatgctgtgcttcatccaggaggcctgccggctggaggacgtgcccgtgcacttcttcaggctgcacaaggataagaaggaaggtcgtcccaccgtgatcctgggactggccctcaggggagtgcacatctaccaggaggtggaccgtgctccgcagctgctgtacgacctcccctggccccacgttgggaagctggcatttctgggaaagaagctggagatccagctggatgggctgcccgcagcacagaagctggtttactacacggggtgcacctggcggtccaggcacctgctgcacctgctgcgcgccagccaccagctccacctccgcgtgcggcccactctgcaacagctgcggcagcgggaggaggcagaagagaagcagcactaccgggagtcctatatcagcgatgagctggagctggacctggccagcaggagcttcccgggcagtggggtcagcagccagcactgcccccactgcctctcacgccactccgccgacagccacggcagttcctacacgtcaggcatcaaggccaactcctggctcagggaatccagagagatgtctgtggacgtgcccttggaggtccacgggctccatgagaaggagccgtcctccagccccaggaccagccgcagccaccccagcacacgtggtgacagccaagccactcgtcaggagccctgcacccaggtcaggaccagaggccagagcgccgaggccgtgcaccagatccaggaaatgacagccggggtcagtgaggagcagcacagccatggcctggacgacatgcagctgcaccagctggccctgcacccagcgcccacctcactcagccataccttccaccgcgccctggactgcaggctggcaggcccctgcgagaccagggccactctccccagcaagaggtccagcaactgtctcgccctggacctgttcggagaggctccaccacaggagtttgtggtgtaggcaccacccacccagcagtaccgtccgcaccgccaggctcagcccctgcccaccccacttccacatggccctcgtcccttcctgcccgccagatgctgcctgcacttc

SEQ ID NO: 7712 - DNA, 556 bp, Homo sapiens
  ENST00000506415
ttttgaacacacggtgacacctgagaagcatggtgactgctctgatgaagccttttgttttgctttcagacaatgagtatatatttatggatttggagcaaaagctcagcaagtacttctcaaaagattggaagaaagaaagaaatgaactgctccgtccagaggggctgtccgcagggggactgtggtgagccctgaggctgcaagcagggaaatgagaaacccagagcccccttcgtggccttcctccgagtgcagcactacgtggaaaacggaagggtcataagcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggaggtacttcgagccacactcctacttcccacagtggatcatcaccaagagggggattgactacatcctccggcacatgcctaccctgcaccgtgagcgccagggcctgagccccaagg

SEQ ID NO: 7713 - DNA, 606 bp, Homo sapiens
  ENST00000511714
atctatctcatgatagaggatggaaaccagccgtccagaagaagagagagttgggccgaggaggactccagggctcagccatgaggagatctgggcggtggtctcctcttcctcgcggcctctgcccgtccactgcccggccctgacatcacgaacgtggcaggccagcctcttccatcacgaacaggccagtcgagaagacaagacattcagaggggcgcgatgtatggaacccagtcctgagaggcctgcatgcagtcagcaggagccgaccctgggaatggacgcgatggcctcggaacacagggatgtcctcgtgctgctgcccagccgggagcaactgcggctggccgtgggggtgaaggctactggccgcgagcttttccagcaagtgtgcaacgtggcgagcatcagagacgcgcagttctttggcctctgtgtggtcagaaacaatgagtatatatttatggatttggagcaaaagctcagcaagtacttctcaaaagattggaagaaagaaagaaatgaaggaaatgagaaacccagagcccccttcgtggccttcctccgagtgcagcactacgtggaaaacggaagggtcataag

SEQ ID NO: 7714 - DNA, 964 bp, Homo sapiens
  ENST00000328788
tgagttatttctgttggccgcattaggaacctgacatttgattcattcagtgggtcctgcctaggtcctttaaaacagaatggactgttagggaaaggctgccctgggccatgcaggccgaggagaccaaggggattggaataaccagtatggcaaaatgcttggtcaagatccagactcgacgaagcctccaattgcacatggtgaaccactgcaacagtaatgtgtttgttcgtctgctgagactcggctccaaggtcacagctcgtaacactggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcagtctccatgcagtaaacagacccagcagaacctgcccgtggtgagctcagccaagacttggctctccatgttccagcctccgtctgtgactgggtgggtaagttcggtgggccccacccagtgggctcggcagccgtcacttcacagaagaagaaaggaaccttgcttaggcctcagatcccagctgtgctctccaatccattaataaagctgcttttaaccctctc

SEQ ID NO: 7715 - DNA, 1397 bp, Homo sapiens
  ENST00000376434
gcttcatttcggaagtgattcatagcacttctgcttacaactctctgatcaggactcatcccaagatcttacccaggatcaaggaaatgcaattctatggtgttcagaagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcagtctccatgcagtaaacagacccagcagaacctgcccgtggtgagctcagccaagacttggctctccatgttccagcctccgtctgtgactgggtgggtaagttcggtgggccccacccagtgggctcggcagccgtcacttcacagaagaagaaaggaaccttgcttaggcctcagatcccagctgtgctctccaatccattaataaagctgcttttaaccctctc

SEQ ID NO: 7716 - DNA, 2198 bp, Homo sapiens
  ENST00000376438
cgcgagcccgccgggggtctcaggctctgggcgtcctcggcgagcgagcccgggcagagggaggcgcacgagcgcgcgcgacagaaggaggcggggaaaggagggggcgaggcggaggcgagcgaacagagggagggacccgcccgccgcgccccggccgctgggcatgtgtgtccgcaggcgcccgacgctgccgatgtcccggggctgagccgcgcccaggtgtcccggacagtgcgtgcgagcgtgtgtgtccgcgcaggcgagcaccgcgccggccctgagcctcccgctcgctccccacggccgcggtgcatgttcgcctcctgccactgtgtgccgagaggcaggaggaccatgaaaatgatccactttcggagctccagcgtcaaatcgctcagccaggagatgagatgcaccatccggctgctggacgactcggagatctcctgccacatccagagggaaaccaaagggcagtttctcattgaccacatctgcaactactacagcctgctggagaaggactactttggcattcgctatgtggacccagagaagcaaaggcactggcttgaacctaacaagtccatcttcaagcaaatgaaaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataaaaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcagtctccatgcagtaaacagacccagcagaacctgcccgtggtgagctcagccaagacttggctctccatgttccagcctccgtctgtgactgggtgggtaagttcggtgggccccacccagtgggctcggcagccgtcacttcacagaagaagaaaggaaccttgcttaggcctcagatcccagctgtgctctccaatccattaataaagctgcttttaaccctctc

SEQ ID NO: 7717 - DNA, 5297 bp, Homo sapiens
  ENST00000304195
gaggcggaggcgagcgaacagagggagggacccgcccgccgcgccccggccgctgggcatgtgtgtccgcaggcgcccgacgctgccgatgtcccggggctgagccgcgcccaggtgtcccggacagtgcgtgcgagcgtgtgtgtccgcgcaggcgagcaccgcgccggccctgagcctcccgctcgctccccacggccgcggtgcatgttcgcctcctgccactgtgtgccgagaggcaggaggaccatgaaaatgatccactttcggagctccagcgtcaaatcgctcagccaggagatgagatgcaccatccggctgctggacgactcggagatctcctgccacatccagagggaaaccaaagggcagtttctcattgaccacatctgcaactactacagcctgctggagaaggactactttggcattcgctatgtggacccagagaagcaaaggcactggcttgaacctaacaagtccatcttcaagcaaatgaaaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataaaaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcaggtattgatctctccttcttatgcgaaatccgccagacaccagagtttgagcagtttcactatgaatactactgtcccctcaaggagtgggtggctgggaaagtccacctcatcctctacatgctgggttgctcatgaagttaatctctcacgtgactaagggctatattcaatgctagtgatttctttttttcagcaaatgcctggttctgaagggtcacggggctgtcaacaggtgttccttactcataattgattattcaaacctttaagttagctttccataattcactgcacttaaataagtttaaatcaaatacagttattttagttacaggttaggaagatggtctttaaataaccaaaaatatgtttattttttattatagtgtagacatacccttcatctattatatcataatacatgttacattggactgaattagattttcccatttctaatagttggcaccattataagctataaggttcagaatcagaattttagtaacaactcaagagaaagttgttgaatataatccttagtgaaaacagtgtcctctaaccaatgcctatacaactaaatttatgctgggtttttggttctgtttttttaaaaatatttttatgtgttcaaactattttggtaaatttttagcaaaaaaaaaaaagaagcctcctggagttatttacatgtacagattgtaagactaatgcacaaaaggtatatcagaatttttttaatgttttggcgctactttgtttttaaaaatatttttggctgaacaataccataatttgttatgatctgcataggagatagaaaatgggtagaaagacactatagtaagtaagctgctaaaacagaggatggaactggaggatgtagaaactgagagcatcaagtggactcagggtggtccatttttcaaagtatttggacaagaggacttgttattttcatttgtattctgtccgtatattttggctggagaagcagatgttttaaaaagaaagtgagagtttaaaggaaaaaaggtaacagatgtgctagtcagttgcatatcaatgtacattaacccaagagtgaaggcagataggaactggagaaatggaaagtggcaaaaatgagttctggtgaggctggcaggcaaatggtgacaggcgaatggtctattttatgaaagtgatggtgatgccagcgttcgatgatgtgaagagcagtgcagtcgctgtctgagttaacatgaacatgtttaagtggatctaaataaaagtggagaaactttaaggtaaatattttgatccctcatgccatttgttgtgattctgtagaagaaacttcaaaaatgtgtttgtatgtgagtgtgcgtgtgtgtgtgtgtgagagagagagagagagagagagagagaatatgaatggctttttgatacatgtccatgatcatgttttgcggtggtcattatactcctttcctttcccagttgttttaaaatttgacttccatagagaaactggagaggcctcatgagatgacataccagttcagcctgggtaaagtagtgacatgaccctaaccagactgtagaggggaccagtgctctagtaccttccttgataccattaaatccatgatggaaaggatttaatccaacaatttaatggtatcaaggaaggtactagagcattgtaccatcagcaacgtactgatgccttcccatgcagactacctgctgatactgtgttatgtgggagaaagataagagtctagaacttatgccatggagcatagagcttctctgtggattgaaaacattccactgccctaatgtacaaagttacagggcccacttggaatcgctctctctagctaatgacattccaaccctatcattagcatgatttctaaattgggcaatacatttccactcactcagtggagctctgagtacttcactggacatttaattttggaaatgagttttgaaactcagttcgtgaagcctgcagtcgagcaaatgactatatatttgccattaagtttgaggggtttcctttcctatatgctttcagtgatttattttgctttttaaataaagattgtttgtttattacctgaaagttgatactgatttaggaatatattttctgtgattggaatcctcaacaatttattttggaagcttgcagatggctaggtttgaaattgaaatttgtgtttttctccttcttttctcatacgacttctaagtcatcctttctgacataaggcaactttagtgtagtctgcacaaaattagtccccttctgatcatgcgtcatataattttctctaaagttctgactatgacaaatcatctggccctcagtctttcaaaataatattatataatattttttaaattatggaactaatatattttccattgtaaaatacttaaaaaatatgatagtataaatatcacatgtaatccaacgatgcagatttatcttaaggagtaataaatatattattttaacatttccagctaacatctcttttctcttaggtggaaacttcattgttgaatagaaatgtttttaagtgaagaagttgacagaatagggtctgctgaatttaaacagccatcaaaagttaaactggaatcttgaaatgccatttgctcggcatagaatcagagccttttagaaacatccatttaagttttgttagaagatagtcaccagttgcctgaatcgaatgaggaaaagcctgcttccagagatggacagtatattatagagtgagatatagagtttaaagcaagtgtgtgagtatatgtatattccatattattggtatatgtgtgtttatatatgaatctgtatatatgtgtgtctttgaatagacacaacatatatgcccctcatgcataattgtgcttattttgccctaattgaggaatttgagatgtattattggttcttctccctctcagatactatggtgggtaaaacccacagcctgaaagggttaaattttccataaatgccactgagtgtacatttgtggatataaataaatatatataatacacacacacatatggcaaatacatatacacacacaatattgcctttagtgctaatgcaagttggatcatgaaaacaatgtaggtaaagtaaagtatgtatttgtctgtgcttgaaaaatattgtaaaatgttatgtatttggaatatattttgtggtttgtctaatatttataaacacaactcggggtgaattcacaatgagtttatttcattgaaatactagagatatgggggccatgttactgtgattggagccttacctttgtatagtgaaatttgcatttctatgtcaacatccagattgttttatatgttaatatggtggcaggaatccctaataaaaatactctggggtaaaa

SEQ ID NO: 7718 - DNA, 604 bp, Homo sapiens
  ENST00000465485
ggctgtcttcgtggaagcaattcagtagcagagcttcccaaatcattcctcctgttcaggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcaggtattgatctctccttcttatgcgaaatccgccagacaccagagtttgagcagtttcactatgaatactactgtcccctcaag

SEQ ID NO: 7719 - DNA, 662 bp, Homo sapiens
  ENST00000431299
ggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagatgtgtacagaagaaaatttgttcctgctttggggtgacttggtgaggagctgtaatgtgaaagtctgcaaaaccaggctatcacactgtaagaagcagaagactacaggatgagagaagctggagaatcttggctccaggcatgttggtgcagatcctgaaagtgcagcctgcccaccaatgagaaaagtctttatggttccctcctcttccccaaattgtacttattcaatgcagcagaaatgaagaggaaatgataaaacatatcattcatctgtttcagaa

SEQ ID NO: 7720 - DNA, 5064 bp, Homo sapiens
  ENST00000621208
agccctagagctcccagagacagaagacgagatggcagtattttaaggcactagcagatcacggcactgcaaatcctttttgtcttggcaaggcacaaggagacctgcttatgcagctttcaaagagggaaaccaaagggcagtttctcattgaccacatctgcaactactacagcctgctggagaaggactactttggcattcgctatgtggacccagagaagcaaaggcactggcttgaacctaacaagtccatcttcaagcaaatgaaaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataaaaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcaggtattgatctctccttcttatgcgaaatccgccagacaccagagtttgagcagtttcactatgaatactactgtcccctcaaggagtgggtggctgggaaagtccacctcatcctctacatgctgggttgctcatgaagttaatctctcacgtgactaagggctatattcaatgctagtgatttctttttttcagcaaatgcctggttctgaagggtcacggggctgtcaacaggtgttccttactcataattgattattcaaacctttaagttagctttccataattcactgcacttaaataagtttaaatcaaatacagttattttagttacaggttaggaagatggtctttaaataaccaaaaatatgtttattttttattatagtgtagacatacccttcatctattatatcataatacatgttacattggactgaattagattttcccatttctaatagttggcaccattataagctataaggttcagaatcagaattttagtaacaactcaagagaaagttgttgaatataatccttagtgaaaacagtgtcctctaaccaatgcctatacaactaaatttatgctgggtttttggttctgtttttttaaaaatatttttatgtgttcaaactattttggtaaatttttagcaaaaaaaaaaaagaagcctcctggagttatttacatgtacagattgtaagactaatgcacaaaaggtatatcagaatttttttaatgttttggcgctactttgtttttaaaaatatttttggctgaacaataccataatttgttatgatctgcataggagatagaaaatgggtagaaagacactatagtaagtaagctgctaaaacagaggatggaactggaggatgtagaaactgagagcatcaagtggactcagggtggtccatttttcaaagtatttggacaagaggacttgttattttcatttgtattctgtccgtatattttggctggagaagcagatgttttaaaaagaaagtgagagtttaaaggaaaaaaggtaacagatgtgctagtcagttgcatatcaatgtacattaacccaagagtgaaggcagataggaactggagaaatggaaagtggcaaaaatgagttctggtgaggctggcaggcaaatggtgacaggcgaatggtctattttatgaaagtgatggtgatgccagcgttcgatgatgtgaagagcagtgcagtcgctgtctgagttaacatgaacatgtttaagtggatctaaataaaagtggagaaactttaaggtaaatattttgatccctcatgccatttgttgtgattctgtagaagaaacttcaaaaatgtgtttgtatgtgagtgtgcgtgtgtgtgtgtgtgagagagagagagagagagagagagagaatatgaatggctttttgatacatgtccatgatcatgttttgcggtggtcattatactcctttcctttcccagttgttttaaaatttgacttccatagagaaactggagaggcctcatgagatgacataccagttcagcctgggtaaagtagtgacatgaccctaaccagactgtagaggggaccagtgctctagtaccttccttgataccattaaatccatgatggaaaggatttaatccaacaatttaatggtatcaaggaaggtactagagcattgtaccatcagcaacgtactgatgccttcccatgcagactacctgctgatactgtgttatgtgggagaaagataagagtctagaacttatgccatggagcatagagcttctctgtggattgaaaacattccactgccctaatgtacaaagttacagggcccacttggaatcgctctctctagctaatgacattccaaccctatcattagcatgatttctaaattgggcaatacatttccactcactcagtggagctctgagtacttcactggacatttaattttggaaatgagttttgaaactcagttcgtgaagcctgcagtcgagcaaatgactatatatttgccattaagtttgaggggtttcctttcctatatgctttcagtgatttattttgctttttaaataaagattgtttgtttattacctgaaagttgatactgatttaggaatatattttctgtgattggaatcctcaacaatttattttggaagcttgcagatggctaggtttgaaattgaaatttgtgtttttctccttcttttctcatacgacttctaagtcatcctttctgacataaggcaactttagtgtagtctgcacaaaattagtccccttctgatcatgcgtcatataattttctctaaagttctgactatgacaaatcatctggccctcagtctttcaaaataatattatataatattttttaaattatggaactaatatattttccattgtaaaatacttaaaaaatatgatagtataaatatcacatgtaatccaacgatgcagatttatcttaaggagtaataaatatattattttaacatttccagctaacatctcttttctcttaggtggaaacttcattgttgaatagaaatgtttttaagtgaagaagttgacagaatagggtctgctgaatttaaacagccatcaaaagttaaactggaatcttgaaatgccatttgctcggcatagaatcagagccttttagaaacatccatttaagttttgttagaagatagtcaccagttgcctgaatcgaatgaggaaaagcctgcttccagagatggacagtatattatagagtgagatatagagtttaaagcaagtgtgtgagtatatgtatattccatattattggtatatgtgtgtttatatatgaatctgtatatatgtgtgtctttgaatagacacaacatatatgcccctcatgcataattgtgcttattttgccctaattgaggaatttgagatgtattattggttcttctccctctcagatactatggtgggtaaaacccacagcctgaaagggttaaattttccataaatgccactgagtgtacatttgtggatataaataaatatatataatacacacacacatatggcaaatacatatacacacacaatattgcctttagtgctaatgcaagttggatcatgaaaacaatgtaggtaaagtaaagtatgtatttgtctgtgcttgaaaaatattgtaaaatgttatgtatttggaatatattttgtggtttgtctaatatttataaacacaactcggggtgaattcacaatgagtttatttcattgaaatactagagatatgggggccatgttactgtgattggagccttacctttgtatagtgaaatttgcatttctatgtcaacatccagattgttttatatgttaatatggtggcaggaatccctaataaaaatactctggggt

SEQ ID NO: 7721 - DNA, 6821 bp, Homo sapiens
  ENST00000357447
gaacgctcacagaacaggcagtgcaattccatgttcctcttaagtatgttagccctaccgggagctgagctggccagtctacttggagaggaaaagtagatctggggaaggtggaagggtcagttcctaagtgacttcctcctcggggatggtaagggcatttgctgatctccagtgactgcctggtgcctcatggtcagactcggctgtctcactcccagatatctgattttgcaaaaagggacacacctatctgcagcaaagaagacactgaccagattgcgagcggtgcttttggatgctctgtagccacccggggcccaggaggactgactcggcagcaggattcgtgcatgggaatcggagaccatggcagtgcagctggtgcccgactcagctctcggcctgctgatgatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactgaagaaacaaaggaaaacctcgtatctgaatgcactgaagaaactgcaggagattgaaaatgcaatcaatgagaaccgcatcaagtctgggaagaaacccacccagagggcttcgctgatcatagacgatggaaacattgccagtgaagacagctccctctcagatgcccttgttcttgaggatgaagactctcaggttaccagcacaatatcccccctacattctcctcacaagggactccctcctcggccaccgtcgcacaacaggcctcctcctccccagtccctggagggactccgacagatgcactatcaccgcaacgactatgacaagtcacccatcaagcccaaaatgtggagtgagtcctctttagatgaaccctatgagaaggtcaagaagcgctcctctcacagccattccagcagccacaagcgcttccccagcacaggaagctgtgcggaagccggcggaggaagcaactccttgcagaacagccccatccgcggcctcccgcactggaactcccagtccagcatgccgtccacgccagacctgcgggtccggagtccccactacgtccattccacgaggtcggtggacatcagccccacccgactgcacagcctcgcactgcactttaggcaccggagctccagcctggagtcccagggcaagctcctgggctcggaaaacgacaccgggagccccgacttctacaccccgcggactcgtagcagcaacggctcagaccccatggacgactgctcgtcgtgcaccagccactcgagctcggagcactactacccggcgcagatgaacgccaactactccacgctggccgaggactcgccgtccaaggcgcgccagaggcagaggcagcggcagcgggcggcgggcgcactgggctcagccagctcgggcagcatgcccaacctggcggcgcgcgggggtgcggggggcgcggggggcgcggggggcggtgtgtacctgcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactggagaagcaacagaaaactcacccattctggatgggtctgagtctccacctcaccaaagtactgatgaatagaggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaaaaataaataaaaacataaaaaattaagaggggccaagaggaagacattctttctgcaaggaaatttcttttaaattctgaactgctactacacacaagtgaaagtcaaccctatgtaaactggtgtcctctctctagccctctcccttactggcccacttctctctccgtagagagcctgaaaaactgccccaatgccacggtaaaggcgaggaagtcttggctggcgttgctgactcacagtcgccatccatctggacacaaagagagacctgtgggagtcgtagagggtactgttagccccggtccatgcagggggttcagccgagcccaagactcaaagctgctttcctttcaggatttgtagtaacgtaaggtgataatggccaaaagtggttctctctcattaaaccaaccagtaaaagcgtatcctatttttttgcacaaggtgtttcattttcgtttttatgggaaaccaagggaaaagcacattgcgatccattcagtgtttaactgtcgtggctcattttctgttcgttagcacttgtgtgacaaaagagctcagatccgacttctcctatgtgtcacttattccaagaacccaactatgcccttaggtagaaagatttgactcgtgtgtctactagccaacaggcagagcagggttgaaaaaaatatcagctcccaaagggcccatgtgtctacatcatcagttactgtcatgcaccacatttgtgtgcagataccaaaagaggaggaaagaagaaaaaaattaatgtgtgggagctgcacgtttacatgttttgagctatgcttcaaacacaactggaaagccatcaatcttcaaaggcctcaaaaatacttttatagtaacaagtgcacgactttagttgggttattcaagatggcacaaaaaggtttccgcagaggtggtatgctgtgcttttggcgcaagtggtggggggatggggtgggggtggaatttttttctcactctaatgacttcctattggaaaggcattgacagccagggacaggagccagggtgggggtagttttgtgggaaagcagaactgaagttagcttaagcataaaaacaaagaaaaatcttcgcttttcatgtatgtggaatccaagaataaccataggctctaccagaccagaagggtaaggatggacactaaaatgaaacaaataccaaggtattccttctgctgcagcctggagaccaccgagagtcgagctggggcacacacacacctggccgggacccggcagggacaaggcgggccgtggcctcctccaccaagtctctctagacaattcagggcctgctttccccagctccatgcatggctggactggtgattccagggtgcagaagggattcatattcccagaacgctttaagtgtacacctgcaggataaagagataccggttacattattaaatgattctagggattcactgggggatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggtagctgatgaggttacatggttacatgttctacatcatgcatagtagcttgaaatctagtctggagaaaactggatcaagattctagcccactggagttgcaaggaatgagaggcaaaaattctaaagatttgggttatattttcaacttgggggacagagagaaatggagagcaggaattacagttccaacaaacatcatgatagtctggtagtcaagacagagattaagtaaaacaggttttactgtttagctgagttcagttaatacaaaatgtacataaaacgttagtcctttgagactgacatgattaatgatcagtgtggtgggaaatgatgtagttattgtacacaagcacttgcaaactctttatccctatttctttaaaacaaaataaggtgaaatacgaagtccttggtctgatataaagcccctattggattcttcggatgcgtaaaagaaattgcctgtttcagccagaagactggtgaaaacacatacatcagactatgttgtgagccaggttgattttttattttattatatgcaggtgagtgttgaaactgttaaaattccaatttgttttcattcagtattagtttagttctaaatatagcaaaccccatccaggtgctatcagatgaccagttactgcttagttaactaggtgtaaagttttacatatacattaatgtcaatagtttattacaagttgtgtaaaatggactctagtttaataatgggggaaaaaagattaggttgctcctgaaactgactgtagagcatgtaaaatgattttactggattctgttcaactgtaatcaatgaaaaagatgtacgttgtagacaaagttgcagaattaaaaaaagaaatctgcttttaatttattctttttgtattaagaatttgtatagtacctttacattttgcaaaacagtgttgtcaacacttattaaagcattttcaaaatgaaaaga

SEQ ID NO: 7722 - DNA, 875 bp, Homo sapiens
  ENST00000475325
ccacctgcatgtagctgccttacctcaaagccagagaagctcgacaccgtcaagtgaaattggagccacccccccaagcagcccccaccacatcctaacctggcagactgggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaaaaataaataaaaacataaaaaattaagaggggccaagaggaagacattctttctgcaaggaa

SEQ ID NO: 7723 - DNA, 1287 bp, Homo sapiens
  ENST00000495956
gcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactgggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaa

SEQ ID NO: 7724 - DNA, 2145 bp, Homo sapiens
  ENST00000264546
atttctccagtgctgctacagaatgggactttttgcttgaccttgtggaaactcatgggttctccaagttgtaaagagttaagaaaagggatggaatgtctggggaatgttgcagggaaggctgcagctctctgctcttagctttctcaccctggaggggatcccaacactcggtggtgcttctgggtctgaggtcttccctaagttctgtttgatctgccaaagagccagcctcagtccactgagaaacagggatgtgccgttatctgcacactgaggtttatttttaccttgtccctggtgagtccccagagacaaggagaaaacactttgggagggagttaagagccttttgcttatccttgaaggaaagcagtctctgaggattagtgagggtggtggtgagggtaggtagggggaggagagtcagaggaatcagagttatttggactgcattttttccttgcctgattaaatcttactgacattggcactttgtgtcactaaaagaacacagccctggatgtggggccagggaccagagggttggcggcagagtctggggctggcatggctgctgggctgcttggctctgaggacccaccgtggagttggaacctgacttgtcgggcgctgaggacctgccaagtgaggaacattcgagttctgcagctgctgctaaaaccatggtgcatctccagggccgtctatcagatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactg

SEQ ID NO: 7725 - DNA, 662 bp, Homo sapiens
  ENST00000632570
ccctcctgagcgctcgctcctctcgctcctctcccctcacccgccgccttccctgctgggtccctctccccggtctccacctctcctccctctcctggaagggaaaagtctgccaagctggggactgccacgaccaaaccaacaaaggccgaccgaaggcggagaacttgaaaagaacttgttttgttccagttaaggaacctgcaggaaaatccacacccacattgcctggttttgaactggagagctgcgtgtgtgtgtatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggatctggtgccaggagacactgcattctactcccaggttctca

SEQ ID NO: 7726 - DNA, 1236 bp, Homo sapiens
  ENST00000632314
gttttctgtccagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggatctggtgccaggagacactgcattctactcccaggtctaaagagacggattgtcatttcccttctttagttctagaacaaccgattcctttcttctttggagcattgtttgctttgaagtttcccctccttccagagaggaaagcaccccttctctgtcttctgaaatcagtggctggtcatcaatatcccctctgtgtcaaaaacagatgagccacgcgtggctcctgacaacgtcctcctggcagaatgtgcgctcatatccggtgctgagtcgcccagggtcttctgaacaattggagcatttctggctcgcggctgaatgaggctgaaagaggctgtccttccatgtgtctgccggccgggaggagagctgctgtttgtgctgctggcgttgcctccacatccgctcctccacacccagctgtccccggctggagtctggagttccccggctggaagctgggaaacccacagtgacacaggcagtgtctccagggtctcaaacaatgttcatagcatcgggaagttcactccaaagatttccaaatgcccccgaaaatgactttctgacttggcgtgagtaactccatctctctctctgcttggatgggaattgtctttttagggtcagccctttttgtcttcctcgttggccagattattagtgaactagttcaatgaaaatcctttggattaggattgaaatgtgctcataaggtcgccaaaaacaacagattctatctttagtatcattcaagtagatcatttcctcccgataactgggaggaaagattttttgctggagaactgacctgatgacactgttttcctgacaataattcagaggcaggcttaaccttc

SEQ ID NO: 7727 - DNA, 2731 bp, Homo sapiens
  ENST00000492155
gtgctgcagcaagaagaatgggcttgacaggctcacactgtgatcttgagttgcctgcccccgaaataaggtcccagcctcctccgccctttgcaaggctcttacacattagtgagcaggaagtggagtcccgatgggaggctgggaatttgaacgccttcccatttcagcactggaggggaggaagctcagttcagcactccacgcagatggctaccgctccctcctgagcgctcgctcctctcgctcctctcccctcacccgccgccttccctgctgggtccctctccccggtctccacctctcctccctctcctggaagggaaaagtctgccaagctggggactgccacgaccaaaccaacaaaggccgaccgaaggcggagaacttgaaaagaacttgttttgttccagttaaggaacctgcaggaaaatccacacccacattgcctggttttgaactggagagctgcgtgtgtgtgtgtatgtgtgtgtgtgtgtcaagcaagaggcggaggaggcacagactacggtctctgttttgataaggaaactgccagctgtcgaaagttaaccagcagagaggggaagatggcccaggagccagcccctcctgagttttaaactacactgttttctgtccagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggtaggcagaggccagctggagggacgccccctgagcatggctgggaccccagaggggacccaggaaggtggggagagctgcagctggggagactgcagggcaagctgctccaaagctggctttgctttccagaccaaggttgggatccaaatgcgaatctgagaaaactgctcccaggaatcaaatagtggaagggaaaaaaaaaaaaaaaagcatcagtagaaccacgcagtgcaagaaggcctgctggtcacacttaagtgtcttcaggtaccccccagagcgtttcacaatccccatggcaagctgtcgggaatgtcaggtccaagggtgaaaagtggaatccgctcatgtgcccacttgtgtgttgtgaatttcaggatctggtgccaggagacactgcattctactcccaggtgggtttctccggcttttaaaaatgcggaatactctctccatcgtgtcgcagggcatgatttctccattcagtgccttttgaaattgcgagtcagagatctggttccgtcgtccgcttccgccagccttggccaagtcattttgtcttttgatgttgggagggacagaggagttccaaggtcctggatctgactgacttaaaaaggggggtgtcatttactgaaatggcaggaggaggagtgggtttgaaagaagcagagaggaagggaggcagccgtggtttggaaatgttagaaaagggcattgtggccgggcacggtggctcacacctctaatcccagcactgtgggaggccgaggctggagaatcacttgaggccagggagtttaagaccagcctgggcaatataatgagaccccgtctctaccaaaaaaaaaaaaaaaaaattaattagccaggtgtggtggcacagcacctgtagtcccagctacttgggaggctgagtagggaggatcactgaaccctggaggttgaggctgcagtgagcagtgactgcactgccctccaacctgggtgacagagcaagaccctgtttcaaaaaacaaaaaaagaaaagtggaatatgagaaaaaaacctgattgatgtaggaaccatgcagctgtctctgagccacgcaaagaaggcaagaaatcttccctggtaatttatattactatatatagtggctgtaaacaataacaaaaaggaaaagacaggagaggaagaggagctaaaaattgtctcgttagcttgtgggctggtgtgatccaatcatagccaggagaaatttaaaggaccagagagaggacagacatccttcctggactgagaggcgaggttactgttctggtgagtggagcgttaagttgaaggcccctccttggacaggctgaggccctccggggaccttagcagtgtgttcacacggtcatgtgtttttataaaatctgtgaacataatatgttttgtatttttcttcagtagaaccgctaaaggccagtgtggtggctcaggcctgtaatctcagcactttgggaggccaaggcaggtggatcacctgaggtctggagttggagaccagtctggccaacacagtgaaaccccatctctactaaaaatacaaaaattagccgagtgtggtggtgcacacctataagcccactacttgggaggctgaggcaggagaatcacttgaactcaggaggcagaggttgcagtgagcagagatcgtgccagtgcactccagcctgggcaacagagcaagactctgtc

SEQ ID NO: 7728 - DNA, 1741 bp, Homo sapiens
  ENST00000342409
tctgcagccacgagaagcaaagttgacatttctggatcactctccccagacgcgtcacttgcccacaagcgggacacggcagtctcgctgagccagctgtgcagagggacagatggaagaaagctagagatgctgcttcgtgggcgctgaagttgcagaacttgggctggttttctttcttcccatcccccctcctcctgacaaaccacatcttgactcagatggtcgaaagaaaaactctttcagttatttgatatttgggaaccctccaggagaccataacttatttttgagggaggctccttctctccctttgctgggaacacacacacacacacacacacacacacacacacacacacacacacacagctgtacaccatggtggttcaggctgcagtggctccgaatagatcccaaagacttttactgaaaattccttatggatctctgagaaggcgcagcgttgaaaggatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggtaggcagaggccagctggagggacgccccctgagcatggctgggaccccagaggggacccaggaaggtggggagagctgcagctggggagactgcagggcaagctgctccaaagctggctttgctttccagaccaaggttgggatccaaatgcgaatctgagaaaactgctcccaggaatcaaatagtggaagg

SEQ ID NO: 7729 - DNA, 495 bp, Homo sapiens
  ENST00000477221
agttcagcactccacgcagatggctaccgctccctcctgagcgctcgctcctctcgctcctctcccctcacccgccgccttccctgctgggtccctctccccggtctccacctctcctccctctcctggaagggaaaagtctgccaagctggggactgccacgaccaaaccaacaaaggccgaccgaaggcggagaacttgaaaagaacttgttttgttccaatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacg

SEQ ID NO: 7730 - DNA, 806 bp, Homo sapiens
  ENST00000640906
tctgcagccacgagaagcaaagttgacatttctggatcactctccccagacgcgtcacttgcccacaagcgggacacggcagtctcgctgagccagctgtgcagagggacagatggaagaaagctagagatgctgcttcgtgggcgctgaagttgcagaacttgggctggttttctttcttcccatcccccctcctcctgacaaaccacatcttgactcagatggtcgaaagaaaaactctttcagttatttgatatttgggaaccctccaggagaccataacttatttttgagggaggctccttctctccctttgctgggaacacacacacacacacacacacacacacacacacacacacacacacacagctgtacaccatggtggttcaggctgcagtggctccgaatagatcccaaagacttttactgaaaattccttatggatctctgagaaggcgcagcgttgaaaggatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcat

SEQ ID NO: 7731 - DNA, 1149 bp, Homo sapiens
  ENST00000493380
gtggggtctccccatccacgtgaagctgtgcttttggatgctctgtagccacccggggcccaggaggactgactcggcagcaggattcgtgcatgggaatcggagaccatggcagtgcagctggtgcccgactcagctctcggcctgctgatgatggagtctcactgtgtcgtgcaggctggagggcaatggtgccatcttggatcactgcaatctccaatctctgcttcccgggttcaagcgattctcctgcttcatcctcctgagtagctggggttgcaggatgatgctcattccaagattttctgttttatttctgtcttttgcaatcgttggcctgctttgctgccataaatgagggaattgtggctaagagagcaatctgccggaagcatctcctcatccatcggtggacactaaccacagctataaccgggacaactagagacactgtccaagtcctctgtcaaattcacaacttagcttgcccttaggtgtgaatacagactgaccccagggccggaggggctgctgttgtgagcctttcctgctggaggggcctaaggactcagttccctttatctaagacaaaaccgaatggagacagtaagagcccatcacactccaccctccctccctcaccttcttgcagagctggtagagtgtagtggccaagagcaggtcctctgcggtgtcacaattggagacctcttctgaatccatccctcaccaactcagtgaccagagctggttacccaacctctcagtgcttcaggtttggtttgatgttttcaatctctagaatgcaacagtcgtagagttggtgagaagattatgcagctgtgctgaggaaagagtaagagctcaaacatgtcagctgtcattcaaatgtcactacaatggccttttttcaagtgtgatccacttgcaccaaaattacctgaggtgcttgtgacaaggatcttacagattcagtctccacggaaggttccagaagtgttttagtgatcgaggcaggggctctacagtcagacagacccaacttcaaatcttaccttgcaccttagttagatctgcgtgatgtgcaacaagttaatgcatttagcttcttggagtctttgtttcaataaattaagacattaatatcta

SEQ ID NO: 7732 - DNA, 1233 bp, Homo sapiens
  ENST00000475141
tgccacgtaagacgtgactttgctccccctttgcctgctgccatgattgtggggtctccccatccacgtgaagctgtgatctatggaggtgggacattgatgtagagttgaggacgataactggcttcaggatttctcaagaaaagctttgagagatctacaccttggaaaccccagccctagaggagtgttcttccaagactccacgaacaggaaaaagtcctggatagcagctgagtgccgccatattaaccctttgggatgggccccagaatctgtgtttccatccagttcccaggtgcttttggatgctctgtagccacccggggcccaggaggactgactcggcagcaggattcgtgcatgggaatcggagaccatggcagtgcagctggtgcccgactcagctctcggcctgctgatggacagagccactcatatgaccacggaaggggggacttggagagaagacacattctggtggtggagatggccttttaggctgttgaaaagctgcctctcccatctttgcaagaatctcaggcagcgaaagaagatactgctgtgttcaccaacccgtgaggaggcttcagattgatgtgactaattgtagagcgggaagctcttggctacgtgtcatttgttgagggcgtgtgagttcagggaaagctgcaagggctggaacatgctagagccgaggattagtttatctttagagccaggataaggatgaataaccaaggggcttcaagggtgttatgatgccatttcggttcttagattataaaggctcaccttcaggacagctagattaaaatagtttttaatggaaattaactggataataaataatgcaaattaagcttttctataaatgaagtgtctttaaatacattatctcatttaattccatccatgaccctatttttaagaccaaaaaaaatctgataattagaatttgggaaactgtcaatggtcacataagtgaaactgatgaagcaagttctcaaaatctcggtcctctgagtcccaagccagtgctttctctgacagcatatcaaagctcaacaatttgacttctaggaccttctaacactttggattcgctcctgaagttagctcccctctgaaccagtcagcattttctgtgtttccaggtgaggaatcctgtctttctgttaatcatctgttcttttccatattgaagtgtaaaataaaaaagggataccacaa

SEQ ID NO: 7733 - DNA, 5060 bp, Homo sapiens
  ENST00000398540
cgggagcccaggcgggcaggccgctggggtcggggctgcacgtacgagagccgggacgcccgggttcagagcgaaggaggaggcatggcttcggtgttcatgtgtggcgtggaggacctgctgttcagcggcagccgcttcgtatggaacttgaccgtgtccacgctgcggagatggtacacggagaggctgcgggcttgccaccaggtgctgcggacgtggtgcgggctgcaggacgtgtaccagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaaggggcaaatcgaagtagagagcgaaaccatcttcaagttagcagcgtttattttacaggaagccaagggagattataccagtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaagttattccaatggaaacagctggagaacttatatttccgtgagaaaaaatttgctgttgaagttcatgatccacgaaggatttcagtttcaagaagaacctttgggcaaagtggcttgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggagacgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaagatctgtctgcgggaggctgagctcacaggcaaaatgccaaaggagtatcccctgaacataggcgagaagcctcctcaggtcagaagacgtgtgggtactgcgttcaaattagatgacaacttgctgccgagtgaagaagatcctgctttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccacctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatcctcgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctgaactgcagttggacctcctgaccaagcactgcgttctcacactagtgtgccttgcaaattgtatttgtcttccgagaggatgttcgttttagaaacctaaagacatcaaaggttgaagagaagacttagttgccctggaagtgaatcagtgaatcacacaccaagccccacaaagcccctaaaggaggatttggcctttcaaactctaggcactaacgtaactgtagggtctgcccacatgttgaagtattgccaagagaggactcagtgtgaagccttcatcaatagcaagcactttttaagggagtaaaagttgttaaaggcaaacctcaaaaacatgaaagggcattcaggatgtcccatggcaataagaacaggggaaatctcagagcacaattcagcaggatgagagaaggggaaccagaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctgttaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggtgaacgttagaaaattaaacaagtctggattccacaagtagttccaagtcaccaagtgacaaaaacaaggttaacattaaaaaagaaaaacaacaacaacgacaaaaagctccaagctgcagtggatttaattatgaggctaaaactacctcatactttccttggaagaactaattagctatggtttattgtagggttttgtttgtttgttttttaaagcaaatgatttccatattccagattgatcttttttgtcatctttgcttcaaaattacataaaaggtgctcctttcccccttcttttatacaagtttcttgttcatattgtgaatagaaaagtttctgaacaacttttttggaacattttctatctatattccaaagcatgtaatatatacataaaaacgatttgttaaactggtccttagtcatttgtataattagaaatgaagtttgggaaaaaattttggaaaaaagacaagcaaaaaaaaataacttattccttttttgcatatttgtatagccttctagaatcagaaataacctttttgcatattcttttattgttctgacttttcaagacctattatttttttacataggtcaataaacaaaaggtgtgctactgaaaatgtttacgttttcttccatttatgtcaggggttcatgtgaagcaggtcgcagtgctctacttcaagtaatcatattgggcaaggcttcggatttttatttatagtattaccgtattttattaattccgggatgtacatttttaaatatttacattaaaaacatggttcatctttttattgatggcatattctacttgaattggcagttttttcttaatagtacattaaaaataatgctgtgtcttacaataaagttgccttagaattgatgaaa

SEQ ID NO: 7734 - DNA, 3761 bp, Homo sapiens
  ENST00000478263
attgtaactcttcctgtagaacctgttcatgtccagggtgagtaaactagggtagaaatgtcttcctaaaacagcctccggtgaaattcgtccttggattcaaagcaacttacttcctaggaagtatcaggcaaatcccaactgccctccattttagaaaggtctcttttctgggaaaatctgccactgagaactttgccctcctctccctgatgggaggaaggagtagaattagggaggtgtcactcaggagagttgctgatgtcagtagtgtgtcagccgtgggaggctcagtttgtgaaattgagttacacctaagtgtcttatgaaactcagttcagaactcaccggagctgccgtctgggaggggggagggcggaagaaccctgaggtttttcctcacatttctgtcccatttttggaacctctggatttaaagaaatgaaaacctcaagtttgtggagattttaagaaatggttattccaatggaaacagctggagaacttatatttccgtgagaaaaaatttgctgttgaagttcatgatccacgaaggatttcagtttcaagaagaacctttgggcaaagtggcttgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggagacgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaagatctgtctgcgggaggctgagctcacaggcaaaatgccaaaggagtatcccctgaacataggcgagaagcctcctcaggtcagaagacgtgtgggtactgcgttcaaattagatgacaacttgctgccgagtgaagaagatcctgctttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccacctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatcctcgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctgaactgcagttggacctcctgaccaagcactgcgttctcacactagtgtgccttgcaaattgtatttgtcttccgagaggatgttcgttttagaaacctaaagacatcaaaggttgaagagaagacttagttgccctggaagtgaatcagtgaatcacacaccaagccccacaaagcccctaaaggaggatttggcctttcaaactctaggcactaacgtaactgtagggtctgcccacatgttgaagtattgccaagagaggactcagtgtgaagccttcatcaatagcaagcactttttaagggagtaaaagttgttaaaggcaaacctcaaaaacatgaaagggcattcaggatgtcccatggcaataagaacaggggaaatctcagagcacaattcagcaggatgagagaaggggaaccagaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctgttaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggtgaacgttagaaaattaaacaagtctggattccacaagtagttccaagtcaccaagtgacaaaaacaaggttaacattaaaaaagaaaa

SEQ ID NO: 7735 - DNA, 561 bp, Homo sapiens
  ENST00000462512
ggtttttatgtgtgtgggaatggacgcaaaggaaaacacagctgagctgcattgtaactcttcctgtagaacctgttcatgtccaggttattccaatggaaacagctggagaacttatatttccgtgagaaaaaatttgctgttgaagttcatgatccacgaaggatttcagtttcaagaagaacctttgggcaaagtggcttgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggagacgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaag

SEQ ID NO: 7736 - DNA, 548 bp, Homo sapiens
  ENST00000497475
gaaactcagttcagaactcaccggagctgccgtctgggaggggggagggcggaagaaccctgaggtttttcctcacatttctgtcccatttttggaacctctggatttaaagaaatgaaaacctcaagtttgtggagattttaagaaatggttattccaatggaaacagctggagaacttatatttccgtgagaaaaaatttgctgttgaagttcatgatccacgaaggatttcagtttcaagaagaacctttgggcaaagtggcttgtttgtgcaaacatggtatgctaactcttctctcatcaagtccatttgggtaatggcaattagtcagcatcagttttacttggaccggaagcaaagcaaagtaagtaactggcatcatttctatagggacagattccccttttgcattctgttcagaagataagccttctcacaaaagatgcaagcacatatatttttgctctctgagatttttttgcgtttaacttccaactatttcaggttttttatatgtttacatgatgggcaatatataagctgct

SEQ ID NO: 7737 - DNA, 505 bp, Homo sapiens
  ENST00000489817
agacggagtctcgctctgtcgcccaggctggagtgcagtggcgcgatctgggctcactgcaacctccgcctcccgggtgcacgccattctcctgcctcagcctcccgagtagctgggactacaggcacccaccagcacgcccggctaattttttttgtatttttagtagagacaaggtttcaccgtgttagcgaggatggtctcgatctcctgacctcgtgatccacctgcctcggcctcccaaagtgctgtgattacaggcgtgagccaccgcgcccggccgagttattccaatggaaacagctggagaacttatatttccgtgagaaaaaatttgctgttgaagttcatgatccacgaaggatttcagtttcaagaagaacctttgggcaaagtggcttgtttgtgcaaacatggtatgctaactcttctctcatcaagtccatttgggtaatggcaattagtcagcatcagttttacttggaccggaagcaaagcaaagtaa

SEQ ID NO: 7738 - DNA, 1830 bp, Homo sapiens
  ENST00000470070
actctgaggactgactcttaccagctggggagcaaacaggccagctggagaccgagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaaggggcaaatcgaagtagagagcgaaaccatcttcaagttagcagcgtttattttacaggaagccaagggagattataccagtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaagttattccaatggaaacagctggagaacttatatttccgtgagaaaaaatttgctgttgaagttcatgatccacgaaggtgaggatcaaagacgtttctctgtatgacacagttactatacaaataacgctgctatcaacatttgtgtacaagtttttatatgaacatatgttttcatttctcttgggtgtatacctaggaatggaattgctgggtcaaatggtaactatctttaaccctctgaggaatggcaaggctgcttttcaaagtgctgcaccattttacatcccaagcagcagtatatgtggttccaatgccgacacatcctcaccgacacttgttatttttagttttgtgtgcatgtatagtttatgccatcctagtgggttgaagtggtaccttcttgtggttttgatttgcacttccctcatgactaatgatggctgagcatcttttcatgtgctgcttagctattcctatatctttagtagagaaatgtctattcagatcttttgctcatttaaaatgttggtgttcttggtcatttaaaaaaaaaaaaaaaagccaaattaccaacatgaactgaagtcaggatgtgggttctcaaatatcttaggagaaatcccgcccccctccgcccgcccccaactgccagacagagtcttactctgtcacccagactgcagtgcagtggcgcaatctttgctcactgcaacctacacctcccaggttcaggtgatgctcatgcctcaacctcccaagtagctgggagtacaggcatgcaccaccacgccaagctaattttgtatttttagtagagacgggctttcaccatgttggccaggctggtctcaaactcctgacctcaggtgatccgcccgtctccgcctcccaaagtgctgagccatggcacccggccttaagagaaattcttaatcagtccttagtgggtacttttcagtcccgagatggttatggatgtttagaggccagagggatgggaggaaatacctgtgataaaaaggtgacctgaagagataagccaaattcctacaaagaac

SEQ ID NO: 7739 - DNA, 566 bp, Homo sapiens
  ENST00000483668
atttgatcgtaaactggaggtgccaagctgtgacagcttcctcaacttcagagccatttgctacaatctaggacagccccatgttcaatgatgctttccttttccatcaacaggggcaaatcgaagtagagagcgaaaccatcttcaagttagcagcgtttattttacaggaagccaagggagattataccagtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaagttattccaatggaaacagctggagaacttatatttccgtgagaaaaaatttgctgttgaagttcatgatccacgaagg

SEQ ID NO: 7740 - DNA, 550 bp, Homo sapiens
  ENST00000487751
acaccccccactttcccctgcaatggtatgatctgcatttgatcgtaaactggaggtgccaagctgtgacagcttcctcaacttcagagccatttgctacaatctaggacagccccatgttcaatgatgctttccttttccatcaacaggggcaaatcgaagtagagagcgaaaccatcttcaagttagcagcgtttattttacagtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaagttattccaatggaaacagctggagaacttatatttccgtgagaaaaaat

SEQ ID NO: 7741 - DNA, 549 bp, Homo sapiens
  ENST00000493880
agaaatgctaatgggaggagcccaaataacagtgacaaaaccttcctgagcaaattctcttctcaagaaattacacttgtgaagccgaggttttacattgagagcatatcgtttttaaaggataaaaccaccgtggagctgtttttcctgaatgcaaaggcctgtgtgcacaaggggcaaatcgaagtagagagcgaaaccatcttcaagttagcagcgtttattttacaggaagccaagggagattataccagtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaag

SEQ ID NO: 7742 - DNA, 569 bp, Homo sapiens
  ENST00000473029
cagcacttgcactctgaggactgactcttaccagctggggagcaaacaggccagctggagaccgagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaaggggcaaatcgaagtagagagcgaaaccatcttcaagttagcagcgtttattttacaggaagccaagggagattataccagtgatgaaaatgccaggaaagatttaaagacattaccagcctttccaaccaaaactcttcaggagcatccatcccttgcctactg

SEQ ID NO: 7743 - DNA, 581 bp, Homo sapiens
  ENST00000460709
actggcttgtagttggagaaaatgcaagcacatgcgcgcacacacacgcgcgcgcacacacacacacaccgcacaagtgcttaatacgtgtgtcttttgtcttaagcactctcttcagttcctttaaatgagccgaggtcatggtggttcggagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaaggggcaaatcgaagtagagagcgaaaccatcttcaagttagcagcgtttattttacaggaagccaagggagattataccagtgatgaaa

SEQ ID NO: 7744 - DNA, 923 bp, Homo sapiens
  ENST00000473188
agggcttcccgtgccccgggagcatcgagggccagcttggtggagcttagcacagcttgctcggcgctgcgagcgggcgggggtggacactgggcttctgtgtgccagtcgcagccgttggctggcgggcacccaatcccagggcatgccgccggagcctggccaggacgcacggtgaaagacgagtttggtggcaggcttgaccccccggctgccagcagaagccggcgtcgggagcccaggcgggcaggccgctggggtcggggctgcacgtacgagagccgggacgcccgggttcagagcgaaggaggaggcatggcttcggtgttcatgtgtggcgtggaggacctgctgttcagcggcagccgcttcgtatggaacttgaccgtgtccacgctgcggagatggtacacggagaggctgcgggcttgccaccaggtgctgcggacgtggtgcgggctgcaggacgtgtaccagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaaggtaggtgccccgtttgtcatgttcactggatgcctccagagcgactgggatgacaggaagaaatggttttgcctctcttcttgcattcaaactaagaaaaaaaaaaa

SEQ ID NO: 7745 - DNA, 846 bp, Homo sapiens
  ENST00000459638
agcgagaggaggcaggcaggacggaaggacgcgagaaaggcggcccggggcacagctgtaagtgtggagcaaagcgaggacgcacggcgagcggcggtggcgggggcgacctgcagacccgggccgggggatgcggcaggcgctggctgcccagagagcccgggagtcgggctgcgtagctcacgtgctgagctggagcttggacagagaggaagaggaagaagaggaaggcagccgccgccggggaaggcacagcgcagagtggacttgcaggactggcgcagagccgggtccccaggtcccgcgcggtgcgcagccgagacaataaagtagccgtctacagccccggagcgccgcagggaggaggtggcggagcaggctttgatgagaaatccagaagaaagagtgtatgaaagaaaaagatgacatctatgcatagcaaacaaaatctgaagattattacagtaaaaacaaaagaaaggcaagagaatacttactagttaaagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaagg

SEQ ID NO: 7746 - DNA, 571 bp, Homo sapiens
  ENST00000462308
agatggacaaagtctttccaccagtaatcagcacttgcactctgaggactgactcttaccagctggggagcaaacaggccagctggagaccgagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacgccaagaggagaaacggaaaaatagatggcaattacgcaataaaagcagtgatgatgaccaacaaccacagattcaaggtcacgttactgggagagggatagcatttctgagattacgcttgttagggccttgcgcagctctgtgtgcaaagttagtctttcacccctagagggcagtcacggccctcctgaggcaccagtccttcaggtcaccgtagtggttccatctcttcacccatttcactttttgttttgccttctcatgttttgaaaggctttgctaaataagctttgtttaccaagaaataacagatag

SEQ ID NO: 7747 - DNA, 555 bp, Homo sapiens
  ENST00000497880
attcctgcgatctgttaggacttgtaaacataccagagccaagtcctctgaacttcgcgaactgatttggtgtgtttgctggtacccagacggctgcgactagaggctgggcctttcgggaagaaagaccttagggtgctgatggcagcagtctttccgggaagctggttgatccttgaagattaggctttgatgagaaatccagaagaaagagtgtatgaaagaaaaagatgacatctatgcatagcaaacaaaatctgaagattattacagtaaaaacaaaagaaaggcaagagaatacttactagttaaagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacaccccaatttgcctacattttatgcagcccgatacattatcagaggaatccttccactttctgcagataatttccaaagagc

SEQ ID NO: 7748 - DNA, 777 bp, Homo sapiens
  ENST00000497757
tgagttctctctcccactttgacagccctgattttgcaactgagtgtagataactttgagcacttcagaatctcctcctacagagacagtagaagtctaaaacggtgtattcagtgacatgcatcctgtaagaagccaaattggctttgatgagaaatccagaagaaagagtgtatgaaagaaaaagatgacatctatgcatagcaaacaaaatctgaagattattacagtaaaaacaaaagaaaggcaagagaatacttactagttaaagagataaggtctcaccatgttgtccagactggacttgaactcctggcttcaagcaatctgcccacctccgcctcccaaagtcctgggatttataggcatgaaccaccgcacctggcctccccaccattttattttctcccgtggctatcacaaccaggaataagagagggagggggacctcagtggtgattttatgctaaggattatggataacaccatccccccattttacaaatgaagaaactggggctcaaaaagcttaattaaatgtctaaggccactgaggcagcaattaaagaggatgtgaagccagtctgctttgtcttcttctggagcctctccttgaggctgacacacctgatcatagccccattatcttaagagtgttagccatatccagtggccagcacactctagacacttctgttattgtagagagacctgttagagatggatgcaagagatttaccctttttcagccttgcctctgctgtcttggggaagtgg

SEQ ID NO: 7749 - DNA, 477 bp, Homo sapiens
  ENST00000493127
gaacttgaccgtgtccacgctgcggagatggtacacggagaggctgcgggcttgccaccaggtgctgcggacgtggtgcgggctgcaggacgtgtaccagataagtaccagtgcaaaagccttttggattatttctcattcttccacttttgcctcacccactccagtttggtctcctcacaagataaggtctcaccatgttgtccagactggacttgaactcctggcttcaagcaatctgcccacctccgcctcccaaagtcctgggatttataggcatgaaccaccgcacctggcctccccaccattttattttctcccgtggctatcacaaccaggaataagagagggagggggacctcagtggtgattttatgctaaggattatggataacaccatccccccattttacaaatgaagaaactggggctcaaaaagcttaattaaatgtctaaggccactgaggcagcaattaa

SEQ ID NO: 7750 - DNA, 574 bp, Homo sapiens
  ENST00000462888
agcagaagccggcgtcgggagcccaggcgggcaggccgctggggtcggggctgcacgtacgagagccgggacgcccgggttcagagcgaaggaggaggcatggcttcggtgttcatgtgtggcgtggaggacctgctgttcagcggcagccgcttcgtatggaacttgaccgtgtccacgctgcggagatggtacacggagaggctgcgggcttgccaccaggtgctgcggacgtggtgcgggctgcaggacgtgtaccagctcatcacctgacagaaatttctaaaagaaacatgtcacctaaactcaacaaaattagtcccaggttctttgaaaagcatttttgaacctttgttgcacagcttgaaaagcatcaagaacggactctccggactcttcaaatgagtgtttgtttttcacattccatcttttcttggtggagcttgtagcataaaataactttctcattcatcccctacttatgtttattctgaacattatatttttgttgtcccagttggttgttgtggaaaagtctgaatgactcaaatgaggaatcagatctgcagttcta

SEQ ID NO: 7751 - DNA, 4971 bp, Homo sapiens
  ENST00000377765
ggccgcgaccgtgcccgccgctgggcggggccgcccttctccgagagcgtcagcccgctaggtccttgtccgcgcgggcggcacctcctctgcaggtaaatggaagagctggagaccagtttattccagacacggaaagcacatagaatagaacaaatggtggcaagatggcttcggcgctcccgggacagctcggcccgggctaaagttgctgcagctgatgggcccgccaggaacccaactcagaccctcatccctgtgcgacacacagtaaagatagacaaagacaccctcctccaggactatggatttcacatttctgagagccttccccttacagtggtggctgtcacagcaggaggctctgctcacggcaagcttttccctggtgatcagatcctccaaatgaacaatgagcctgctgaagacctttcctgggaacgagcagtcgatattctcagggaagcagaagattctctttcaatcacagttgttcgctgcacgtcgggagtccctaaatcgtccttcctgaccgaggagaagagagccagactgaagaccaaccccgtgaaggtgcactttgctgaagaagtgctcatcagtggacacagccagggtaattctctgctgtgtatgcccaacgtgctcaagctatacttggagaatggacagaccaaagctttcaagtttgaggcaaacacaaccgtgaaggacatcatcctcaccgtgaaggagaagctgtccatccgaagtatcgagtactttgcactggccctggaagagcagtacagcatctcccggctgcacctgctgcacgaagaggaactcatccagcaggtggtagaaagggaggagtcacatgactaccgctgcctcttcagggtctgttttgttcccaaggaccccctggacctcctgaaagaagaccccgtggcctttgaatacctctatctgcagagctgcagcgatgtgctccaggagcgctttgctgtagaaatgaaatgtagctctgcactccgactcgcggctctgcacatccaggaacggatctacgcctgtgcccagccacagaagatctctttaaagtatatagagaaagactggggaatagagaactttatatctccaactttactccgaaacatgaaaggcaaagacatcaagaaagccattagcttccacatgaagaggaaccagaatttgctggaaccccgacagaagcaacttatttctgctgcccagctacgtttaaattatctacagatcctcggagaactcaagacatatggtggaagaatctttaatgctactttaatgttacaggatagagaatcctacattgcccttctagttggagccaagtatgggattagccaggttatcaatagcaaactcaacatcatgtccacattggcagagtttgcaaacatcagccgtgtagagctaacggaagagtctgagaaagtgagcgtcgtcaaagtgtatcttcaggacgtcaaggttctgactttgctgctggaatccaacagtgcaaaagacctagcctgcctgattgctgggtactacaggctgttggttgacccagttacctccattttcctctggcctggaaacaaacaacaagcgcaccgggtatctgcagaagaaggctatgaatccagggcctgcagtgactcagaggagtcctctgaggtggactgcgtactcgaacctctctctgacaggcgcctggtgaaactggcaccctgcagatcactcataaaggaggagcagcctcctgggaacagccccacacctgaggtggctaggaggggccccagcacctgcggggccagcagcacgacagacagtgccgagtccgaggcgtccgactcagccaacactgagagccgcggctacaggaccagtggctcgagtgagtccatggacgctctggaagaggatgacttagacacctgctcctccagcaggtccaccttcttccactttggctcgccaggcctcgcagagagcattgactctgacagccaggaggagagaagcgggattgaaaccagtggcttcctctgtctcctggacctggcccagagagccaacccccagtgccagaagacagagttttccgagagtgctgctttggagacatttggctgggcaccagaactgagcacagtcaggctggaccccaggctgtatgaaggcagccacgctgactactacagcctgtgttccagtgtctccccggccagctacctgagtgacagttccgagagtacagcttcccggcaagggggagccccgccagcctggggtcagcagggctggactgaggcccagcccagttccatgctggaacccctggccctgcacccaccactggcctttgaggatggcagctcagatgaggaatactatgacgcggctgataagctcactcccccaggccccccgtcagggcccagagatgtttctactgcagaacccagtgccacaagcttgcagaataaggccagcacttctagccctgagaacagcctgccttgtgggccagatggaagacagccaagcaggaggggaggggtgaagaaatatgccaagaccctgaggaaaagaaggtctttcctacagaccgactacacctctcaggtctcatttcccctggtgccatcagcctccctggagagtgtagacgacgtgtgctactatgacagggagccctacctggcccttggtgcaccctccccaactgtgtcctctctgcaggacatgcagggtgagcctggccttctggagaccaaggccttggggctgctggctcctctgagggagaccaagagcacaaacccagcctccagggtcatggagatggagcccgagaccatggaaaccaaatcagtcatcgactctcgagtgtcttctatttctgccattcgcttccggattgaccccaacaataaagagaattctggtgttgtccctgctgccagctcctcagcaagcactcctcactgttctaacccaggttcatctggcccagatactgctcaggcaaggccttcccaaatcttacctctatctcaagacctggatgggattgcccccaaagaaccaaccatagagcatggagacagctccttctccctctccagtggtgaccctaacccagacagagcctgcctggccagcaacccaggactaaataatgtctctcaaggagacacactagagctccagttggagccccatgtccagttggaaatgggattggaatctttttgtacaaatcatatacaagaaactgcccccaaatacacagagcctttgttgtctcctagagatgagcctagaagtgatgaatgtggaataaatccaggagagaagatagcttctatccctacaaaggaagagccacaaggacaactatctctggaaagagacagagaagttacaaacaaaaatggcaccaacgtatttcaggaggagtctaggaaggattcaggtgactccccgggtgatgtgtcaaataatgtttcacagactcttgatattagctctccagctggtaaaatagtaacctccctttctttagatgctcctgtaacagggaccgagcagatcccaccacatccccctagagaccctcaaggacagagcagagaacccccagggcaaggctgccaggctcaagaacaaaaactattcgtagagttggatttagaccctgatttctttcttgggaagcagacagtttcaccagccgtccctccagaggggatcaaggcagaggcacctaaccatgtgacagggcaagatatagcccctagggacagccctgagtgggtctgttttaatcctgagccttccctgccagaaccactaccatgtccacaagaggatcctcacttagaaacttcaaaccattgcttactctcagaaggcaaaagtgacagctctagcatctgcctttctgctgagaagtcttttctgtgctttgccccagaaagccatcctgaagtctctgccagtctcagggtggccacatctttgggttttgcaggcatgaatgagatggtggctcccaggatagggatggaccagtgcagctgtcagttctcctatgccacatgcttccgtggcccgcagcctgagacagaggaagaagacagggacttggaagcacaccccatggcccccctcacctcaccgccctctgcgggaagcccggtggttctgccctggaggcctgcccgagcccacagctgcaccaccgcacccctgtcgaggaaaagccacatctggccagagtactgctccagggcactgagacagctgaaagccacccctgccagcacccctgagggcttcatccaactcatggagagcttgctggagctacaagacattttagaaacttcctggggggttggaaacaaacatcccccagagaagtgcacctggcactttaccgaaagccggagccgcctctgcatgggctcccagaagctcctgtcgagctgtcggcatgtgatcagaatggaccagtcccccgaagagatgcagggggccgtgcgtgacaccttccagcacctggtccagctggccggcctgtgctttcagttcacagactgtagccgctgctccgcccggcacagggaggcagcggggaacctgagggatgtggtgtacacctaccatcagtttatagaggctgctaaatcgacctgcgagagaggctaccacgacctgagtgtgaaactcctggcccgtcagtgcacggccctcacggccgccgtgttctgtttgacccagaagttccgggcatccacggccctgtaaacaggtcaacggcccaagggcctcctgccctgtcctgccttggacacttccctgagaagccccttccactctcccacccaccctcttcaaatgtttactatatagagtattcaaataaactgctgcttaatcttg

SEQ ID NO: 7752 - DNA, 5465 bp, Homo sapiens
  ENST00000539465
gaacacaactgggcagaactagcaggagaccaagtattatgtggcacagaataaactctacaactataaaatggatgcatcatgagaccttgggtgtcatcttctgtgttgcccttggcacagaggaagccagtttgccaatcaaggacctctagggtttcctctctcgactggctcaagtggttgaggtcttgaggatgagaatgccatctgcaggactcctgtgcctgtcgtgctgaaaggagagaagccagacatgttgacaggcatagctgcagctgcccagtatccgcagatgaggagggtcatgctcctgtgaggagggggcccgtgccacagagataccacccaactttgcccacatggcctggcagtcggttttacttgggcttatcgatgagctatgggaaggtcatttgatattcacattcttgtggccgcaatgttgggaatgtggccttttatctttaaaaatagctgtgtgctgggaggcccgggagcagtgtcctgggatggaggggagctgccagcagggggaagaggtgtggatttctttccgaggaagagtcccttcagctctgtgccactggtaaatggaagagctggagaccagtttattccagacacggaaagcacatagaatagaacaaatggtggcaagatggcttcggcgctcccgggacagctcggcccgggctaaagttgctgcagctgatgggcccgccaggaacccaactcagaccctcatccctgtgcgacacacagtaaagatagacaaagacaccctcctccaggactatggatttcacatttctgagagccttccccttacagtggtggctgtcacagcaggaggctctgctcacggcaagcttttccctggtgatcagatcctccaaatgaacaatgagcctgctgaagacctttcctgggaacgagcagtcgatattctcagggaagcagaagattctctttcaatcacagttgttcgctgcacgtcgggagtccctaaatcgtccttcctgaccgaggagaagagagccagactgaagaccaaccccgtgaaggtgcactttgctgaagaagtgctcatcagtggacacagccagggtaattctctgctgtgtatgcccaacgtgctcaagctatacttggagaatggacagaccaaagctttcaagtttgaggcaaacacaaccgtgaaggacatcatcctcaccgtgaaggagaagctgtccatccgaagtatcgagtactttgcactggccctggaagagcagtacagcatctcccggctgcacctgctgcacgaagaggaactcatccagcaggtggtagaaagggaggagtcacatgactaccgctgcctcttcagggtctgttttgttcccaaggaccccctggacctcctgaaagaagaccccgtggcctttgaatacctctatctgcagagctgcagcgatgtgctccaggagcgctttgctgtagaaatgaaatgtagctctgcactccgactcgcggctctgcacatccaggaacggatctacgcctgtgcccagccacagaagatctctttaaagtatatagagaaagactggggaatagagaactttatatctccaactttactccgaaacatgaaaggcaaagacatcaagaaagccattagcttccacatgaagaggaaccagaatttgctggaaccccgacagaagcaacttatttctgctgcccagctacgtttaaattatctacagatcctcggagaactcaagacatatggtggaagaatctttaatgctactttaatgttacaggatagagaatcctacattgcccttctagttggagccaagtatgggattagccaggttatcaatagcaaactcaacatcatgtccacattggcagagtttgcaaacatcagccgtgtagagctaacggaagagtctgagaaagtgagcgtcgtcaaagtgtatcttcaggacgtcaaggttctgactttgctgctggaatccaacagtgcaaaagacctagcctgcctgattgctgggtactacaggctgttggttgacccagttacctccattttcctctggcctggaaacaaacaacaagcgcaccgggtatctgcagaagaaggctatgaatccagggcctgcagtgactcagaggagtcctctgaggtggactgcgtactcgaacctctctctgacaggcgcctggtgaaactggcaccctgcagatcactcataaaggaggagcagcctcctgggaacagccccacacctgaggtggctaggaggggccccagcacctgcggggccagcagcacgacagacagtgccgagtccgaggcgtccgactcagccaacactgagagccgcggctacaggaccagtggctcgagtgagtccatggacgctctggaagaggatgacttagacacctgctcctccagcaggtccaccttcttccactttggctcgccaggcctcgcagagagcattgactctgacagccaggaggagagaagcgggattgaaaccagtggcttcctctgtctcctggacctggcccagagagccaacccccagtgccagaagacagagttttccgagagtgctgctttggagacatttggctgggcaccagaactgagcacagtcaggctggaccccaggctgtatgaaggcagccacgctgactactacagcctgtgttccagtgtctccccggccagctacctgagtgacagttccgagagtacagcttcccggcaagggggagccccgccagcctggggtcagcagggctggactgaggcccagcccagttccatgctggaacccctggccctgcacccaccactggcctttgaggatggcagctcagatgaggaatactatgacgcggctgataagctcactcccccaggccccccgtcagggcccagagatgtttctactgcagaacccagtgccacaagcttgcagaataaggccagcacttctagccctgagaacagcctgccttgtgggccagatggaagacagccaagcaggaggggaggggtgaagaaatatgccaagaccctgaggaaaagaaggtctttcctacagaccgactacacctctcaggtctcatttcccctggtgccatcagcctccctggagagtgtagacgacgtgtgctactatgacagggagccctacctggcccttggtgcaccctccccaactgtgtcctctctgcaggacatgcagggtgagcctggccttctggagaccaaggccttggggctgctggctcctctgagggagaccaagagcacaaacccagcctccagggtcatggagatggagcccgagaccatggaaaccaaatcagtcatcgactctcgagtgtcttctatttctgccattcgcttccggattgaccccaacaataaagagaattctggtgttgtccctgctgccagctcctcagcaagcactcctcactgttctaacccaggttcatctggcccagatactgctcaggcaaggccttcccaaatcttacctctatctcaagacctggatgggattgcccccaaagaaccaaccatagagcatggagacagctccttctccctctccagtggtgaccctaacccagacagagcctgcctggccagcaacccaggactaaataatgtctctcaaggagacacactagagctccagttggagccccatgtccagttggaaatgggattggaatctttttgtacaaatcatatacaagaaactgcccccaaatacacagagcctttgttgtctcctagagatgagcctagaagtgatgaatgtggaataaatccaggagagaagatagcttctatccctacaaaggaagagccacaaggacaactatctctggaaagagacagagaagttacaaacaaaaatggcaccaacgtatttcaggaggagtctaggaaggattcaggtgactccccgggtgatgtgtcaaataatgtttcacagactcttgatattagctctccagctggtaaaatagtaacctccctttctttagatgctcctgtaacagggaccgagcagatcccaccacatccccctagagaccctcaaggacagagcagagaacccccagggcaaggctgccaggctcaagaacaaaaactattcgtagagttggatttagaccctgatttctttcttgggaagcagacagtttcaccagccgtccctccagaggggatcaaggcagaggcacctaaccatgtgacagggcaagatatagcccctagggacagccctgagtgggtctgttttaatcctgagccttccctgccagaaccactaccatgtccacaagaggatcctcacttagaaacttcaaaccattgcttactctcagaaggcaaaagtgacagctctagcatctgcctttctgctgagaagtcttttctgtgctttgccccagaaagccatcctgaagtctctgccagtctcagggtggccacatctttgggttttgcaggcatgaatgagatggtggctcccaggatagggatggaccagtgcagctgtcagttctcctatgccacatgcttccgtggcccgcagcctgagacagaggaagaagacagggacttggaagcacaccccatggcccccctcacctcaccgccctctgcgggaagcccggtggttctgccctggaggcctgcccgagcccacagctgcaccaccgcacccctgtcgaggaaaagccacatctggccagagtactgctccagggcactgagacagctgaaagccacccctgccagcacccctgagggcttcatccaactcatggagagcttgctggagctacaagacattttagaaacttcctggggggttggaaacaaacatcccccagagaagtgcacctggcactttaccgaaagccggagccgcctctgcatgggctcccagaagctcctgtcgagctgtcggcatgtgatcagaatggaccagtcccccgaagagatgcagggggccgtgcgtgacaccttccagcacctggtccagctggccggcctgtgctttcagttcacagactgtagccgctgctccgcccggcacagggaggcagcggggaacctgagggatgtggtgtacacctaccatcagtttatagaggctgctaaatcgacctgcgagagaggctaccacgacctgagtgtgaaactcctggcccgtcagtgcacggccctcacggccgccgtgttctgtttgacccagaagttccgggcatccacggccctgtaaacaggtcaacggcccaagggcctcctgccctgtcctgccttggacacttccctgagaagccccttccactctcccacccaccctcttcaaatgtttactatatagagtattcaaataaactgctgcttaatcttg

SEQ ID NO: 7753 - DNA, 499 bp, Homo sapiens
  ENST00000359927
ggggtcgggagttggagaccagcctgaccaacatggagaaaccccaactctactaaaaatacaaaattagccgggcatggtggcgcatgcctgtaatcccagctactcgggaggctgaggcaggagaatcgcttgaacccgggaggcggaggttgtggtgagctgagatcacgccattgcactccagcctgggcaacaagagcaaaactctctctcaaaaaaaaaaaaagaaaagaaaaaagaaagtaaataggggatttgaacagaaacaggtttgcaggtagaaaaaaacgtctcaaccactgaggtaaatggaagagctggagaccagtttattccagacacggaaagcacatagaatagaacaaatggtggcaagatggcttcggcgctcccgggacagctcggcccgggctaaagttgctgcagctgatgggcccgccaggaacccaactcagaccctcatccctgtgcgacacacagtaaagatagacaaaga

SEQ ID NO: 7754 - DNA, 2699 bp, Homo sapiens
  ENST00000635925
attcttgtgtgtgtgtatgtctatgtttttctccccaaattcagaccatgataagtttgtgcaaatggccaatttgagtcctgcacaccaggcccggtctaagcctctcatttggattcagagattgtcatgctcagaaaacgagttgtttgtatccaggcttcagggtgctgcaggaggcctgctgagtacatcaatggataacttcaacgtggacggcagcaaggaggctggagcagaaggcatcgggcgcagcccctgcactggccgggagcagctgaagagtgcctgtgtgatccagaagccaatgacctgggactctctctctggaccacctgttcagagcatgcatgcaggctcaaagaataataggaggaagagctttatagctgaaccgggccgagaaattgtacgtgtgacactgaaacgtgacccacatcgtggttttgggtttgtcattaatgagggagagtattcaggccaagctgaccctggcatttttatatcttctattatacctggaggaccagcagaaaaagcaaaaacgatcaaaccaggagggcagatactagccctgaatcacatcagtctggagggcttcacattcaacatggctgttaggatgatccagaattcccctgacaacatagaattaattatttctcagtcaaaaggtgttggtggaaataacccagatgaagaaaagaatagcacagccaattctggggtctcctctacagacatcctgagcttcgggtaccagggaagtttgttgtcacacacacaagaccaggacagaaatactgaagaactagacatggctggggtgcagagcttagtgcccaggctgagacatcagctttcctttctgccgttaaagggtgctggttcttcttgtcctccatcacctccagaaatcagtgctggtgaaatctactttgtggaactggttaaagaagatgggacacttggattcagtgtaactggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgtgcagtgcctgacgggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagtcctgaattggatggggaggatggggaaggtgacatgtaccatccatgtggagccccttctcccacctcggaggatgaagagtatcttaccatcaactctacatgccaaggccagctaccctgtgaagaatgtttggaggcagattctgggaccattcccttgccacagttctgctcttggggcactgtcccagagtctttgcctccagaagagtccccagagagtgggagtgaatgggaagacctggaggagcctgtggccctggaatacggtgccctcaggtctctctcttttgggggtctgaatgtctagtgctgattcctgttttgcctgctcctacctgcccctctgctggatgtactgcagagaagagtcttggtgtcctgtcatagggcccatcttgttggactgctgtggctgagtatagaccagcatcaggaaagtctcactgttaatgcaaggagccaccagaagctgacctggtcaccaggcagggtcagaacatattgatgaggacacagaaaaaataaacacagagaacagccgtcttccgaggcagagactgagggtttctgcatggaggtcctttggatagaagagccctcaggtgaccttggtccaaagagtgtacccaccagctctgccactgggaaagaaacctgtaggctcctgcaaaggtgacctgggatgaagggcctggcccagttgttaagagctcacttcaaga

SEQ ID NO: 7755 - DNA, 4453 bp, Homo sapiens
  ENST00000637395
aaagacagcggcaacagtgctggtggcagggagctccgcggacagacttgcaagagacccctgctccttgttggaaagttgtcccatgatgaaggcctagacctggtcacggagacttttggatgcagcctttaacgaaggacgcaggcatgagcctgtcctctgtgacgctggccagcgccctacaggtcaggggtgaagctctgtctgaggaggaaatctggtccctcctgttcctggccgctgagcagctcctggaagacctccgcaacgcccctgcagctctgcgagcccctgcactccatcctgctgaccatgtgtgaagaccagcctcacaggcggtgcacgttgcagtcggttctggaagcttgtcgggttcatgagaaagaagtgtctgtctacccagcccctgctggtctccacatcagaaggctggttggcttggttctgggtaccatttctgaggtggagaaaagagttgtggaggaaagctcctctgtgcagcagaacagaagctacctgctcaggaagaggctgcgtgggacaagcagcgagagcccagcggcacaggccccggagtgtctgcatccttgcagagtttcagaaagaagcacggagacccagagctcaccagagccccattggagcaccttgacacacagtcactgcagcctccttgttaaccgcgctcttccaggagcagatccccaggaccagcaggcgggccggaggctcagctctggatctgtgcactcggcagcagacagctcatggccaacaactccttctcagaggggttttctgcaaagaaggagcaagttttccaggccagagttcatcctgttggctggagaggccccgatgacactacatctgccgggatcggttgtgaccaaaaaagggaaatcctatttggctctcagggacctctgtgtggtcctgctgaacgggcagcacctggaggtaaaatgtgatgttgaatcaacagtgggagctgtcttcaatgccgtgacatcctttgccaacctcgaggaactcacctactttggcttggcgtatatgaaaagcaaagagttctttttcctggacagtgaaaccagattgtgcaaaatagctcctgaaggctggagagagcagcctcagaagacctccatgaataccttcacactcttcctgaggataaagttctttgtcagccactatgggctgctccagcacagcctgacaaggcaccagttttacctgcagcttcggaaagatatcctggaggagaggctgtactgcaatgaagagatactgctgcagctgggggtccttgccttgcaggctgagtttggcaattaccctaaggagcaggtggagagtaagccatactttcacgttgaagattacatcccagcgagtctgatcgagaggatgaccgctctacgggtccaggttgaagtctcagagatgcaccggctcagctctgcactgtggggagaggatgctgagctgaagttcttgagggtcactcagcagctcccagaatacggtgtgctggttcaccaagtattctcagagaagaggaggccagaagaggagatggccctggggatctgtgccaagggtgtcatagtctatgaagtgaaaaacaacagcagaattgcaatgttacggtttcagtggagagaaaccgggaagatttctacttatcaaaaaaagttcaccatcacaagcagtgtcactgggaagaagcacacatttgtcacagattcagccaagaccagtaaatacttactggacctctgctcagcccagcatgggtttaatgcacagatgggctctgggcagccttcccatgttttatttgaccatgataagtttgtgcaaatggccaatttgagtcctgcacaccaggcccggtctaagcctctcatttggattcagagattgtcatgctcagaaaacgagttgtttgtatccaggcttcagggtgctgcaggaggcctgctgagtacatcaatggataacttcaacgtggacggcagcaaggaggctggagcagaaggcatcgggcgcagcccctgcactggccgggagcagctgaagagtgcctgtgtgatccagaagccaatgacctgggactctctctctggaccacctgttcagagcatgcatgcaggctcaaagaataataggaggaagagctttatagctgaaccgggccgagaaattgtacgtgtgacactgaaacgtgacccacatcgtggttttgggtttgtcattaatgagggagagtattcaggccaagctgaccctggcatttttatatcttctattatacctggaggaccagcagaaaaagcaaaaacgatcaaaccaggagggcagatactagccctgaatcacatcagtctggagggcttcacattcaacatggctgttaggatgatccagaattcccctgacaacatagaattaattatttctcagtcaaaaggtgttggtggaaataacccagatgaagaaaagaatagcacagccaattctggggtctcctctacagacatcctgagcttcgggtaccagggaagtttgttgtcacacacacaagaccaggacagaaatactgaagaactagacatggctggggtgcagagcttagtgcccaggctgagacatcagctttcctttctgccgttaaagggtgctggttcttcttgtcctccatcacctccagaaatcagtgctggtgaaatctactttgtggaactggttaaagaagatgggacacttggattcagtgtaactggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgtgcagtgcctgacgggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagtcctgaattggatggggaggatggggaaggtgacatgtaccatccatgtggagccccttctcccacctcggaggatgaagagtatcttaccatcaactctacatgccaaggccagctaccctgtgaagaatgtttggaggcagattctgggaccattcccttgccacagttctgctcttggggcactgtcccagagtctttgcctccagaagagtccccagagagtgggagtgaatgggaagacctggaggagcctgtggccctggaatacggtgccctcaggtctctctcttttgggggtctgaatgtctagtgctgattcctgttttgcctgctcctacctgcccctctgctggatgtactgcagagaagagtcttggtgtcctgtcatagggcccatcttgttggactgctgtggctgagtatagaccagcatcaggaaagtctcactgttaatgcaaggagccaccagaagctgacctggtcaccaggcagggtcagaacatattgatgaggacacagaaaaagtaagggcaacagaaactgtcacactgggaggaagggaggttaaattctgggcaggtctgtaaccacccaacattctgttaaagtacttacagtgtatatttaaaaatgctgaatgttccaaaaactttcacataaacacagtttca

SEQ ID NO: 7756 - DNA, 4194 bp, Homo sapiens
  ENST00000636244
atgcagcctttaacgaaggacgcaggcatgagcctgtcctctgtgacgctggccagcgccctacaggtcaggggtgaagctctgtctgaggaggaaatctggtccctcctgttcctggccgctgagcagctcctggaagacctccgcaacgattcctcggactatgtggtttgcccctggtcagccctgctttctgcagctggaagcctttctttccaaggccgtgtttctcatatagaggctgctcctttcaaggcccctgaactgctacagggacagagtgaggatgagcagcctgatgcatctcagatgcatgtctattctttaggaatgaccctctactggtcagcagggtttcatgttccgccacatcagcccctgcagctctgcgagcccctgcactccatcctgctgaccatgtgtgaagaccagcctcacaggcggtgcacgttgcagtcggttctggaagcttgtcgggttcatgagaaagaagtgtctgtctacccagcccctgctggtctccacatcagaaggctggttggcttggttctgggtaccatttctgaggtggagaaaagagttgtggaggaaagctcctctgtgcagcagaacagaagctacctgctcaggaagaggctgcgtgggacaagcagcgagagcccagcggcacaggccccggagtgtctgcatccttgcagagtttcagaaagaagcacggagacccagagctcaccagagccccattggagcaccttgacacacagtcactgcagcctccttgttaaccgcgctcttccaggagcagatccccaggaccagcaggcgggccggaggctcagctctggatctgtgcactcggcagcagacagctcatggccaacaactccttctcagaggggttttctgcaaagaaggagcaagttttccaggccagagttcatcctgttggctggagaggccccgatgacactacatctgccgggatcggttgtgaccaaaaaagggaaatcctatttggctctcagggacctctgtgtggtcctgctgaacgggcagcacctggaggtaaaatgtgatgttgaatcaacagtgggagctgtcttcaatgccgtgacatcctttgccaacctcgaggaactcacctactttggcttggcgtatatgaaaagcaaagagttctttttcctggacagtgaaaccagattgtgcaaaatagctcctgaaggctggagagagcagcctcagaagacctccatgaataccttcacactcttcctgaggataaagttctttgtcagccactatgggctgctccagcacagcctgacaaggcaccagttttacctgcagcttcggaaagatatcctggaggagaggctgtactgcaatgaagagatactgctgcagctgggggtccttgccttgcaggctgagtttggcaattaccctaaggagcaggtggagagtaagccatactttcacgttgaagattacatcccagcgagtctgatcgagaggatgaccgctctacgggtccaggttgaagtctcagagatgcaccggctcagctctgcactgtggggagaggatgctgagctgaagttcttgagggtcactcagcagctcccagaatacggtgtgctggttcaccaagtattctcagagaagaggaggccagaagaggagatggccctggggatctgtgccaagggtgtcatagtctatgaagtgaaaaacaacagcagaattgcaatgttacggtttcagtggagagaaaccgggaagatttctacttatcaaaaaaagttcaccatcacaagcagtgtcactgggaagaagcacacatttgtcacagattcagccaagaccagtaaatacttactggacctctgctcagcccagcatgggtttaatgcacagatgggctctgggcagccttcccatgttttatttgaccatgataagtttgtgcaaatggccaatttgagtcctgcacaccaggcccggtctaagcctctcatttggattcagagattgtcatgctcagaaaacgagttgtttgtatccaggcttcagggtgctgcaggaggcctgctgagtacatcaatggataacttcaacgtggacggcagcaaggaggctggagcagaaggcatcgggcgcagcccctgcactggccgggagcagctgaagagtgcctgtgtgatccagaagccaatgacctgggactctctctctggaccacctgttcagagcatgcatgcaggctcaaagaataataggaggaagagctttatagctgaaccgggccgagaaattgtacgtgtgacactgaaacgtgacccacatcgtggttttgggtttgtcattaatgagggagagtattcaggccaagctgaccctggcatttttatatcttctattatacctggaggaccagcagaaaaagcaaaaacgatcaaaccaggagggcagatactagccctgaatcacatcagtctggagggcttcacattcaacatggctgttaggatgatccagaattcccctgacaacatagaattaattatttctcagtcaaaaggtgttggtggaaataacccagatgaagaaaagaatagcacagccaattctggggtctcctctacagacatcctgagcttcgggtaccagggaagtttgttgtcacacacacaagaccaggacagaaatactgaagaactagacatggctggggtgcagagcttagtgcccaggctgagacatcagctttcctttctgccgttaaagggtgctggttcttcttgtcctccatcacctccagaaatcagtgctggtgaaatctactttgtggaactggttaaagaagatgggacacttggattcagtgtaactggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgtgcagtgcctgacgggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagtcctgaattggatggggaggatggggaaggtgacatgtaccatccatgtggagccccttctcccacctcggaggatgaagagtatcttaccatcaactctacatgccaaggccagctaccctgtgaagaatgtttggaggcagattctgggaccattcccttgccacagttctgctcttggggcactgtcccagagtctttgcctccagaagagtccccagagagtgggagtgaatgggaagacctggaggagcctgtggccctggaatacggtgccctcaggtctctctcttttgggggtctgaatgtctag

SEQ ID NO: 7757 - DNA, 1959 bp, Homo sapiens
  ENST00000474573
agttgctgagcacccgccttgtaccagtgcttgggctggggacatgcccagatctctcacatagttgctattgttaagcttatgaacacctaatcttattgctcagtggagaatacaatctaaacgaacaggtgaatacagaagacagtgccagtcggagggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgtgcagtgcctgacgggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagatattccttctcatctcctctaaccagactttcgacagatattttctgagcaccttctctgcatgtctgcagtgctgtgtaaaatgccctacctttgcatggactattctttctaatcaagaggcgtgtgtggcgaacttggggcagcccctggaagtcttgttctttgaccattacgtctgcggctgcatcaccagataatgagcttcaccactcgtctgcctcctgtgtccttccgcggggagtaaatgtcacttcagcttgccgcatctctaaataggcaaattttcagtgctcagaaaaggacctgatctttgcacaaagtgctttgatggttgcctgcttgagtcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagacgcttcttgaccatctagttttgtcaaatgagaaaactgaggttccaaagaagtcaataaacttgtccaaagtctgaccgactctgcttgccatgtgacgagtctgtcttagaactgggtcattgccctgcttgcaatgctgtgccctctggcaagcccccccatccccccggtctcctgagctcggtaaggtgctccagctgcttctatcatagcacttcctacatggactgtaacatttctttactgctccaacttctcattaaattgggggctcctcaaagcca

SEQ ID NO: 7758 - DNA, 4997 bp, Homo sapiens
  ENST00000374201
gagctcttcctggctctctcacgggtcactggctttgaggacgcaggctgctggggtggcagtgcctgctaacaggccagagactgcgcaggacccagggaatgagagtggtggcaggaaagggaaggggccttgttgactcactcgctgggcagcaagtgcttagtgacaagcagtaaacaaagacagcggcaacagtgctggtggcagggagctccgcggacagacttgcaagagacccctgctccttgttggaaagttgtcccatgatgaaggcctagacctggtcacggagacttttggatgcagcctttaacgaaggacgcaggcatgagcctgtcctctgtgacgctggccagcgccctacaggtcaggggtgaagctctgtctgaggaggaaatctggtccctcctgttcctggccgctgagcagctcctggaagacctccgcaacgattcctcggactatgtggtttgcccctggtcagccctgctttctgcagctggaagcctttctttccaaggccgtgtttctcatatagaggctgctcctttcaaggcccctgaactgctacagggacagagtgaggatgagcagcctgatgcatctcagatgcatgtctattctttaggaatgaccctctactggtcagcagggtttcatgttccgccacatcagcccctgcagctctgcgagcccctgcactccatcctgctgaccatgtgtgaagaccagcctcacaggcggtgcacgttgcagtcggttctggaagcttgtcgggttcatgagaaagaagtgtctgtctacccagcccctgctggtctccacatcagaaggctggttggcttggttctgggtaccatttctgaggtggagaaaagagttgtggaggaaagctcctctgtgcagcagaacagaagctacctgctcaggaagaggctgcgtgggacaagcagcgagagcccagcggcacaggccccggagtgtctgcatccttgcagagtttcagaaagaagcacggagacccagagctcaccagagccccattggagcaccttgacacacagtcactgcagcctccttgttaaccgcgctcttccaggagcagatccccaggaccagcaggcgggccggaggctcagctctggatctgtgcactcggcagcagacagctcatggccaacaactccttctcagaggggttttctgcaaagaaggagcaagttttccaggccagagttcatcctgttggctggagaggccccgatgacactacatctgccgggatcggttgtgaccaaaaaagggaaatcctatttggctctcagggacctctgtgtggtcctgctgaacgggcagcacctggaggtaaaatgtgatgttgaatcaacagtgggagctgtcttcaatgccgtgacatcctttgccaacctcgaggaactcacctactttggcttggcgtatatgaaaagcaaagagttctttttcctggacagtgaaaccagattgtgcaaaatagctcctgaaggctggagagagcagcctcagaagacctccatgaataccttcacactcttcctgaggataaagttctttgtcagccactatgggctgctccagcacagcctgacaaggcaccagttttacctgcagcttcggaaagatatcctggaggagaggctgtactgcaatgaagagatactgctgcagctgggggtccttgccttgcaggctgagtttggcaattaccctaaggagcaggtggagagtaagccatactttcacgttgaagattacatcccagcgagtctgatcgagaggatgaccgctctacgggtccaggttgaagtctcagagatgcaccggctcagctctgcactgtggggagaggatgctgagctgaagttcttgagggtcactcagcagctcccagaatacggtgtgctggttcaccaagtattctcagagaagaggaggccagaagaggagatggccctggggatctgtgccaagggtgtcatagtctatgaagtgaaaaacaacagcagaattgcaatgttacggtttcagtggagagaaaccgggaagatttctacttatcaaaaaaagttcaccatcacaagcagtgtcactgggaagaagcacacatttgtcacagattcagccaagaccagtaaatacttactggacctctgctcagcccagcatgggtttaatgcacagatgggctctgggcagccttcccatgttttatttgaccatgataagtttgtgcaaatggccaatttgagtcctgcacaccaggcccggtctaagcctctcatttggattcagagattgtcatgctcagaaaacgagttgtttgtatccaggcttcagggtgctgcaggaggcctgctgagtacatcaatggataacttcaacgtggacggcagcaaggaggctggagcagaaggcatcgggcgcagcccctgcactggccgggagcagctgaagagtgcctgtgtgatccagaagccaatgacctgggactctctctctggaccacctgttcagagcatgcatgcaggctcaaagaataataggaggaagagctttatagctgaaccgggccgagaaattgtacgtgtgacactgaaacgtgacccacatcgtggttttgggtttgtcattaatgagggagagtattcaggccaagctgaccctggcatttttatatcttctattatacctggaggaccagcagaaaaagcaaaaacgatcaaaccaggagggcagatactagccctgaatcacatcagtctggagggcttcacattcaacatggctgttaggatgatccagaattcccctgacaacatagaattaattatttctcagtcaaaaggtgttggtggaaataacccagatgaagaaaagaatagcacagccaattctggggtctcctctacagacatcctgagcttcgggtaccagggaagtttgttgtcacacacacaagaccaggacagaaatactgaagaactagacatggctggggtgcagagcttagtgcccaggctgagacatcagctttcctttctgccgttaaagggtgctggttcttcttgtcctccatcacctccagaaatcagtgctggtgaaatctactttgtggaactggttaaagaagatgggacacttggattcagtgtaactggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgtgcagtgcctgacgggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagatattccttctcatctcctctaaccagactttcgacagatattttctgagcaccttctctgcatgtctgcagtgctgtgtaaaatgccctacctttgcatggactattctttctaatcaagaggcgtgtgtggcgaacttggggcagcccctggaagtcttgttctttgaccattacgtctgcggctgcatcaccagataatgagcttcaccactcgtctgcctcctgtgtccttccgcggggagtaaatgtcacttcagcttgccgcatctctaaataggcaaattttcagtgctcagaaaaggacctgatctttgcacaaagtgctttgatggttgcctgcttgagtcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagacgcttcttgaccatctagttttgtcaaatgagaaaactgaggttccaaagaagtcaataaacttgtccaaagtctgaccgactctgcttgccatgtgacgagtctgtcttagaactgggtcattgccctgcttgcaatgctgtgccctctggcaagcccccccatccccccggtctcctgagctcggtaaggtgctccagctgcttctatcatagcacttcctacatggactgtaacatttctttactgctccaacttctcattaaattgggggctcctcaaagcca

SEQ ID NO: 7759 - DNA, 4665 bp, Homo sapiens
  ENST00000305531
gagtacgggcccggacatgttcctggacattgcagaggccctgtcacatgcatgtctttattgtaggcatgagcctgtcctctgtgacgctggccagcgccctacaggtcaggggtgaagctctgtctgaggaggaaatctggtccctcctgttcctggccgctgagcagctcctggaagacctccgcaacgattcctcggactatgtggtttgcccctggtcagccctgctttctgcagctggaagcctttctttccaaggccgtgtttctcatatagaggctgctcctttcaaggcccctgaactgctacagggacagagtgaggatgagcagcctgatgcatctcagcccctgcagctctgcgagcccctgcactccatcctgctgaccatgtgtgaagaccagcctcacaggcggtgcacgttgcagtcggttctggaagcttgtcgggttcatgagaaagaagtgtctgtctacccagcccctgctggtctccacatcagaaggctggttggcttggttctgggtaccatttctgaggtggagaaaagagttgtggaggaaagctcctctgtgcagcagaacagaagctacctgctcaggaagaggctgcgtgggacaagcagcgagagcccagcggcacaggccccggagtgtctgcatccttgcagagtttcagaaagaagcacggagacccagagctcaccagagccccattggagcaccttgacacacagtcactgcagcctccttgttaaccgcgctcttccaggagcagatccccaggaccagcaggcgggccggaggctcagctctggatctgtgcactcggcagcagacagctcatggccaacaactccttctcagaggggttttctgcaaagaaggagcaagttttccaggccagagttcatcctgttggctggagaggccccgatgacactacatctgccgggatcggttgtgaccaaaaaagggaaatcctatttggctctcagggacctctgtgtggtcctgctgaacgggcagcacctggaggtaaaatgtgatgttgaatcaacagtgggagctgtcttcaatgccgtgacatcctttgccaacctcgaggaactcacctactttggcttggcgtatatgaaaagcaaagagttctttttcctggacagtgaaaccagattgtgcaaaatagctcctgaaggctggagagagcagcctcagaagacctccatgaataccttcacactcttcctgaggataaagttctttgtcagccactatgggctgctccagcacagcctgacaaggcaccagttttacctgcagcttcggaaagatatcctggaggagaggctgtactgcaatgaagagatactgctgcagctgggggtccttgccttgcaggctgagtttggcaattaccctaaggaggtggagagtaagccatactttcacgttgaagattacatcccagcgagtctgatcgagaggatgaccgctctacgggtccaggttgaagtctcagagatgcaccggctcagctctgcactgtggggagaggatgctgagctgaagttcttgagggtcactcagcagctcccagaatacggtgtgctggttcaccaagtattctcagagaagaggaggccagaagaggagatggccctggggatctgtgccaagggtgtcatagtctatgaagtgaaaaacaacagcagaattgcaatgttacggtttcagtggagagaaaccgggaagatttctacttatcaaaaaaagttcaccatcacaagcagtgtcactgggaagaagcacacatttgtcacagattcagccaagaccagtaaatacttactggacctctgctcagcccagcatgggtttaatgcacagatgggctctgggcagccttcccatgttttatttgaccatgataagtttgtgcaaatggccaatttgagtcctgcacaccaggcccggtctaagcctctcatttggattcagagattgtcatgctcagaaaacgagttgtttgtatccaggcttcagggtgctgcaggaggcctgctgagtacatcaatggataacttcaacgtggacggcagcaaggaggctggagcagaaggcatcgggcgcagcccctgcactggccgggagcagctgaagagtgcctgtgtgatccagaagccaatgacctgggactctctctctggaccacctgttcagagcatgcatgcaggctcaaagaataataggaggaagagctttatagctgaaccgggccgagaaattgtacgtgtgacactgaaacgtgacccacatcgtggttttgggtttgtcattaatgagggagagtattcaggccaagctgaccctggcatttttatatcttctattatacctggaggaccagcagaaaaagcaaaaacgatcaaaccaggagggcagatactagccctgaatcacatcagtctggagggcttcacattcaacatggctgttaggatgatccagaattcccctgacaacatagaattaattatttctcagtcaaaaggtgttggtggaaataacccagatgaagaaaagaatagcacagccaattctggggtctcctctacagacatcctgagcttcgggtaccagggaagtttgttgtcacacacacaagaccaggacagaaatactgaagaactagacatggctggggtgcagagcttagtgcccaggctgagacatcagctttcctttctgccgttaaagggtgctggttcttcttgtcctccatcacctccagaaatcagtgctggtgaaatctactttgtggaactggttaaagaagatgggacacttggattcagtgtaactggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgtgcagtgcctgacgggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagatattccttctcatctcctctaaccagactttcgacagatattttctgagcaccttctctgcatgtctgcagtgctgtgtaaaatgccctacctttgcatggactattctttctaatcaagaggcgtgtgtggcgaacttggggcagcccctggaagtcttgttctttgaccattacgtctgcggctgcatcaccagataatgagcttcaccactcgtctgcctcctgtgtccttccgcggggagtaaatgtcacttcagcttgccgcatctctaaataggcaaattttcagtgctcagaaaaggacctgatctttgcacaaagtgctttgatggttgcctgcttgagtcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagacgcttcttgaccatctagttttgtcaaatgagaaaactgaggttccaaagaagtcaataaacttgtccaaagtctgaccgactctgcttgccatgtgacgagtctgtcttagaactgggtcattgccctgcttgcaatgctgtgccctctggcaagcccccccatccccccggtctcctgagctcggtaaggtgctccagctgcttctatcatagcacttcctacatggactgtaacatttctttactgctccaacttctcattaaattgggggctcctcaaagcc

SEQ ID NO: 7760 - DNA, 1684 bp, Homo sapiens
  ENST00000491130
gagaagaagggagtgagactgctcagagaggcaggattcctgctgactccagggggacacctggcacctcagcttcctttcccacttctccaggctgcatggaggggtgccgggcaggggcctcctggaagggaacctcctgcagcctcaagcaccaggtcatgacatgacatctatccctttcccaggtgaccgactcctgcaggtggatggagtgattctgtgcggcctcacccacaagcaggctgtgcagtgcctgacgggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagatattccttctcatctcctctaaccagactttcgacagatattttctgagcaccttctctgcatgtctgcagtgctgtgtaaaatgccctacctttgcatggactattctttctaatcaagaggcgtgtgtggcgaacttggggcagcccctggaagtcttgttctttgaccattacgtctgcggctgcatcaccagataatgagcttcaccactcgtctgcctcctgtgtccttccgcggggagtaaatgtcacttcagcttgccgcatctctaaataggcaaattttcagtgctcagaaaaggacctgatctttgcacaaagtgctttgatggttgcctgcttgagtcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagacgcttcttgaccatctagttttgtcaaatgagaaaactgaggttccaaagaagtcaataaacttgtccaaagtctgac

SEQ ID NO: 7761 - DNA, 1845 bp, Homo sapiens
  ENST00000463706
cagggagcaggggacagagctgggattcggattggcctccagagcagaaaccttcaccccaggccttcctctgggtgctggttcttcttgtcctccatcacctccagaaatcagtgctggtgaaatctactttgtggaactggttaaagaagatgggacacttggattcagtgtaactgtaagagtttttaggagagcttgaaaagcagttaacaagatgtccgtctagaacctggtggccattccacccagatggcaacctctgacagtgtgcttagtttgcacaaatgtaaggggtaaataaaaaagccagtgggggcctgcactgggggatgagttcagagacaaacagaggtactggggaacctcaggatgagcagggcatgcactaggggactccaaactcatgaggaggcagtgtgggcagagttggctgatgtgtcctgactctgaggtcaagctggactgcagagagagagaagcacattggggcttcagggacacaagctaaagggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgtgcagtgcctgacgggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagagatactgtaaatccaacctgccaaaactaaatgcagttgtcaggagcagagacctggggctcccagctgtgtcatcagggctaatggagacctcaatatggggcctgatgttggagaactggagacatgaagggacacaaaccccaaactttgttgtgagtttaaccgtaagtaaataggacaattataataccttcatatttcaagcctgaaatgcccaatctgcttctatgaatttcctcctgaaaggcagagatgaatttggtggcccaagtctttaaaggacagctgtccagaaaagttgggcacagtgtcttttctcagtaaacattctgtagcaagcag

SEQ ID NO: 7762 - DNA, 561 bp, Homo sapiens
  ENST00000477710
aatgaaaaatgcacatatcctttggcccatcaaagcacacaagacgtgccaggcacaagccttcaggcccacagccatatccacctacgctggtcactacctatatagagatagtggtgcatcccacgtgagcagttgctgagcacccgccttgtaccagtgcttgggctggggacatgcccagatctctcacatagttgctattgttaagcttatgaacacctaatcttattgctcagtggagaatacaatctaaacgaacaggtgaatacagaagacagtgccagtcggaggtaaggtcatgggatagagtggtgggcaggtggggattcccttagctggggaggttggggaggcttcctggaggaggaaagatgggtggtgagttttttgttgtgtttttcagggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgt

SEQ ID NO: 7763 - DNA, 3466 bp, Homo sapiens
  ENST00000486151
agtgctggtggcagggagctccgcggacagacttgcaagagacccctgctccttgttggaaagttgtcccatgatgaaggcctagacctggtcacggagacttttggatgcagcctttaacgaaggacgcaggcatgagcctgtcctctgtgacgctggccagcgccctacaggtcaggggtgaagctctgtctgaggaggaaatctggtccctcctgttcctggccgctgagcagctcctggaagacctccgcaacgattcctcggactatgtggtttgcccctggtcagccctgctttctgcagctggaagcctttctttccaaggccgtgtttctcatatagaggctgctcctttcaaggcccctgaactgctacagggacagagtgaggatgagcagcctgatgcatctcagatgcatgtctattctttaggaatgaccctctactggtcagcagggtttcatgttccgccacatcagcccctgcagctctgcgagcccctgcactccatcctgctgaccatgtgtgaagaccagcctcacaggcggtgcacgttgcagtcggttctggaagcttgtcgggttcatgagaaagaagtgtctgtctacccagcccctgctggtctccacatcagaaggctggttggcttggttctgggtaccatttctgaggtggagaaaagagttgtggaggaaagctcctctgtgcagcagaacagaagctacctgctcaggaagaggctgcgtgggacaagcagcgagagcccagcggcacaggccccggagtgtctgcatccttgcagagtttcagaaagaagcacggagacccagagctcaccagagccccattggagcaccttgacacacagtcactgcagcctccttgttaaccgcgctcttccaggagcagatccccaggaccagcaggcgggccggaggctcagctctggatctgtgcactcggcagcagacagctcatggccaacaactccttctcagaggggttttctgcaaagaaggagcaagttttccaggccagagttcatcctgttggctggagaggccccgatgacactacatctgccgggatcggttgtgaccaaaaaagggaaatcctatttggctctcagggacctctgtgtggtcctgctgaacgggcagcacctggaggtaaaatgtgatgttgaatcaacagtgggagctgtcttcaatgccgtgacatcctttgccaacctcgaggaactcacctactttggcttggcgtatatgaaaagtggagagtaagccatactttcacgttgaagattacatcccagcgagtctgatcgagaggatgaccgctctacgggtccaggttgaagtctcagagatgcaccggctcagctctgcactgtggggagaggatgctgagctgaagttcttgagggtcactcagcagctcccagaatacggtgtgctggttcaccaagtattctcagagaagaggaggccagaagaggagatggccctggggatctgtgccaagggtgtcatagtctatgaagtgaaaaacaacagcagaattgcaatgttacggtttcagtggagagaaaccgggaagatttctacttatcaaaaaaagttcaccatcacaagcagtgtcactgggaagaagcacacatttgtcacagattcagccaagaccagtaaatacttactggacctctgctcagcccagcatgggtttaatgcacagatgggctctgggcagccttcccatgttttatttgaccatgataagtttgtgcaaatggccaatttgagtcctgcacaccaggcccggtctaagcctctcatttggattcagagattgtcatgctcagaaaacgagttgtttgtatccaggcttcagggtgctgcaggaggcctgctgagtacatcaatggataacttcaacgtggacggcagcaaggaggctggagcagaaggcatcgggcgcagcccctgcactggccgggagcagctgaagagtgcctgtgtgatccagaagccaatgacctgggactctctctctggaccacctgttcagagcatgcatgcaggctcaaagaataataggaggaagagctttatagctgaaccgggccgagaaattgtacgtgtgacactgaaacgtgacccacatcgtggttttgggtttgtcattaatgagggagagtattcaggccaagctgaccctggcatttttatatcttctattatacctggaggaccagcagaaaaagcaaaaacgatcaaaccaggagggcagatactagccctgaatcacatcagtctggagggcttcacattcaacatggctgttaggatgatccagaattcccctgacaacatagaattaattatttctcagtcaaaaggtgttggtggaaataacccagatgaagaaaagaatagcacagccaattctggggtctcctctacagacatcctgagcttcgggtaccagggaagtttgttgtcacacacacaagaccaggacagaaatactgaagaactagacatggctggggtgcagagcttagtgcccaggctgagacatcagctttcctttctgccgttaaagggtgctggttcttcttgtcctccatcacctccagaaatcagtgctggtgaaatctactttgtggaactggttaaagaagatgggacacttggattcagtgtaactgtaagagtttttaggagagcttgaaaagcagttaacaagatgtccgtctagaacctggtggccattccacccagatggcaacctctgacagtgtgcttagtttgcacaaatgtaaggggtaaataaaaaagccagtgggggcctgcactgggggatgagttcagagacaaacagaggtactggggaacctcaggatgagcagggcatgcactaggggactccaaactcatgaggaggcagtgtgggcagagttggctgatgtgtcctgactctgaggtcaagctggactgcagagagagagaagcacattggggcttcagggacacaagctaaaggtaagaagggcagtccactgtcatctggccaaggatgggtggggcagtccactgtcatccagcatagaatcagtgtggagcctcttgctcagacatcccagggccaggcctccatcaggactgacactttccatttggtttctgagctctgcctggtagacccttgtgaaaggagattacccatataactgtgtttacccaaggggttggggaatggcacacacaaagctggtgaaaatccagaggtcagaggttggaaggtgctgcttttattactgagtattgaaagtgatccattacaggctgggctcggtggctcatgactgtaatcccagaactttgggaggccgaggcgggtggatcgcaaggtcaggagattgagactatcctggctaacatggtgaaaccccatctctact

SEQ ID NO: 7764 - DNA, 531 bp, Homo sapiens
  ENST00000494505
agttgtgcgtcagtggagggttgtggatgatcagtgtattaaagtctgtgtttgcttccttcagcaaaaaaagttcaccatcacaagcagtgtcactgggaagaagcacacatttgtcacagattcagccaagaccagtaaatacttactggacctctgctcagcccagcatgggtttaatgcacagatgggctctgggcagccttcccatgttttatttgaccatgataagtttgtgcaaatggccaatttgagtcctgcacaccaggcccggtctaagcctctcatttggattcagagattgtcatgctcagaaaacgagttgtttgtatccaggcttcagggtgctgcaggaggcctgctgagtacatcaatggataacttcaacgtggacggcagcaaggaggctggagcagaaggcatcgggcgcagcccctgcactggccgggagcagctgaagagtgcctgtgtgatccagaagccaatgacctgggactctctctctggaccacctgttcagagcatgcatgc

SEQ ID NO: 7765 - DNA, 606 bp, Homo sapiens
  ENST00000505547
ccacttcatattcttctcacccagcacactccttgaaaaatagttattgtttgataaacaatttgattgatgaatgaaggaaaaactaaaaagagggattttctttaagctaaggaaaatatcaggccatagtcagacagcatctgccatgcacccgtggatgcctgctacagggtgtggaaccaagggaccgagcattttcttgcagttgtgcgtcagtggagggttgtggatgatcagtgtattaaagtctgtgtttgcttccttcagcaaaaaaagttcaccatcacaagcagtgtcactgggaagaagcacacatttgtcacagattcagccaagaccagtaaatacttactggacctctgctcagcccagcatgggtttaatgcacagatgggctctgggcagccttcccatgttttatttgaacacagtcacatggcccccaagacaactgcaagacgggttggaaagggaggacttcctgtgtgcccaggaagaggaagtagtgtaacgatacaccatggtccttgccataacggctgcagccgtctgctgtatcactcttaattgagagtttggtattaaactcatagcaggaccaga

SEQ ID NO: 7766 - DNA, 619 bp, Homo sapiens
  ENST00000468556
caggtcaggggtgaagctctgtctgaggaggaaatctggtccctcctgttcctggccgctgagcagctcctggaagacctccgcaacgattcctcggactatgtggtttgcccctggtcagccctgctttctgcagctggaagcctttctttccaaggccgtgtttctcatatagaggctgctcctttcaaggcccctgaactgctacagggacagagtgaggatgagcagcctgatgcatctcagatgcatgtctattctttaggaatgaccctctactggtcagcagggtttcatgttccgccacatcagcccctgcagctctgcgagcccctgcactccatcctgctgaccatgtgtgaagaccagcctcacaggcggtgcacgttgcagtcggttctggaagcttgtcgggttcatgagaaagaagtgtctgtctacccagcccctgctggtctccacatcagaaggctggttggcttggttctgggtaccatttctgaggtcagtagagaaccgtgcttttcaagcagtagctgctggtcatgtgtggctattaaaatttgaattagttatattatcattaactaaaataaaataaaaaattaaattaatcagt

SEQ ID NO: 7767 - DNA, 682 bp, Homo sapiens
  ENST00000492045
ctcctgttcctggccgctgagcagctcctggaagacctccgcaacgattcctcggactatgtggtttgcccctggtcagccctgctttctgcagctggaagcctttctttccaaggccgtgtttctcatatagaggctgctcctttcaaggcccctgaactgctacagggacagagtgaggatgagcagcctgatgcatctcaggtaagctgtgcagctactctgcaacttctgagtcctgtgccctgggaaaggcctgtcccagcggcagcctccccagctcccagctcagccttgcagagcttggttctcaacaccaagccagagtgggtttcaagagttttattcccaggatttcttgtcaacaacttactagctcatggacaagggcaagtccacttctctgagccccaatttctacattggtaaaatggggttaatgtggcttaattgatcaggttattatcaatattcaaaaagaagtgttgaaaagctgtggttaagtggtctggcacattgttaccattggcagtatgtagcaagacacctcaaaatgacccaacacgtcctcaactaggaatttattctaaggcacaagtaaagataaatttagctgcagcaatgctgattgttgtattgctgacgttagtgataaattgaaaacaagctaaatagtgagtgg

SEQ ID NO: 7768 - DNA, 8465 bp, Homo sapiens
  ENST00000380682
gggaggcagctgcagtgctgcgaggggtgcgtgcgcgtgtgcccagctcgcctgccgtctcccggctccgtctgcgctcctcggtgcgtggggcacgagggtccgagggccgggaagccagagcagcgcctctcgcccaggcctcgctttctctggacgcccggcagtccccggggctagagcgcacggggcggggcgcgagacccgggccgcgctccccgcccccgcctcttgcgccctgcctggctccctctccattgagttttcctgcctcgggtgcctatcaatggtcctgctcggggatgcacacgcagctcgcggccggaggggggtagcagccgccgcctccaggtgcaggttctctccggccgccgccgccacccgctgtcgccgcgactcgagccccgggcgcactgaggtcttggccatggggctgcggaggctgctgttgctggcgtgagaaggggcgacggagttgtcgcgctcgggggtccccagctgcctgcatggatgtcttcagctttgtgaagattgcaaagctttcgagccacaggacgaagtcttcaggctggccgcctccctcgggaacctggggcttgagccaggtgccgccctatggatgggagatgacggcaaaccgagatgggcgagactacttcatcaatcacatgacacaggcaatcccttttgacgaccctcggttagagagctgccaaatcatccctccggctcctcggaaggtggagatgagaagggaccccgtgctgggatttggttttgtggcaggcagtgaaaagccagtggtcgttcgctcagtaacaccaggtggcccctctgaaggcaagctgatcccgggagatcagattgtaatgattaatgatgaaccggtcagcgctgcacccagagagcgggtcatcgatctggtcagaagctgcaaagaatcgatactcctcactgtcattcagccttacccttctcccaaatcagcatttattagtgctgcaaaaaaggcaagattaaagtccaatcctgtcaaagtacgcttctctgaggaggtcatcatcaacggccaagtgtcggaaactgttaaggacaactcacttctttttatgccaaatgttttgaaagtctatctggaaaatgggcagaccaaatcatttcgttttgactgcagcacttccattaaggatgtcatcttaacccttcaagagaagctctccatcaaaggcattgaacacttctctctcatgctggagcagaggacagaaggggctggaacgaagctgctcttgcttcatgaacaggagactctaactcaggtgacacagaggcccagctcccataagatgagatgtcttttccgaattagcttcgtcccaaaagatccaattgaccttttaaggagagatccagttgctttcgagtatctctatgttcagagttgtaacgatgtggttcaggagcgatttgggccggagctgaaatatgacatagccctgcggctggccgcattacaaatgtacattgcaaccgttaccaccaagcaaacgcagaaaatctccctcaaatacatcgaaaaagaatggggattagagacttttcttccctctgctgtgctgcaaagcatgaaagagaagaacataaagaaagcactttcacaccttgtcaaagcaaatcaaaacttggtaccaccgggtaaaaagctctctgcactacaagccaaggtccattatctcaagttcctcagtgacctacgattgtatgggggccgtgtgttcaaggcaacattagtgcaggcagaaaagcgctcggaagtgactctcctggttgggccccggtatggcataagccatgtcatcaacaccaaaaccaatctggtggctcttttagccgactttagccacgtcaacaggatcgaaatgttttccgaggaggagagcttggtgcgggtagaactccacgtgctagatgtgaagcctatcacgcttctgatggaatcctcagatgccatgaacctggcctgcttgacggctggatactaccggctgcttgttgattccaggaggtcgatatttaacatggccaacaagaaaaacacagcgacccaggaaacaggacctgaaaacaaggggaagcataacctccttggcccagattggaactgtataccccaaatgaccacctttattggcgaaggggaacaagaagcccagataacatacatagattcaaagcagaagacggtggagatcacagacagcaccatgtgtccaaaagagcaccggcacttgtacatagacaatgcctatagttcagatggacttaaccagcagctgagccagcccggggaggccccctgtgaggcagactacagaagtctagctcagcggtccctattgaccctctcaggaccagaaactctgaagaaagcacaggaatctccgagaggagctaaagtgtcctttatttttggagacttcgccttggatgatggtattagtcccccaacccttggctatgaaacgctactagatgagggtcctgaaatgctggagaagcagagaaatctctacattggcagtgccaatgacatgaagggcctggatctcactccagaggcagagggcatccagtttgtggaaaattctgtttatgcaaacataggcgatgtgaagagcttccaggccgcggaggggatcgaggaacccctcttgcatgacatctgttatgcagaaaacactgatgacgcggaggacgaggacgaggtgagctgcgaggaggacctcgtggtgggggagatgaaccagccggccatcctcaacctgtctgggtcaagcgatgacatcattgacctcacatccctgccccctccagaaggtgatgacaatgaggatgacttcctgttgcgttccttgaacatggccattgccgcacccccacctggctttagagacagttcagatgaagaggactctcagagccaggcagcttccttccccgaggacaaggagaaaggcagcagcctgcaaaatgatgagatccccgtgtccctcattgacgctgtgcccaccagcgccgaaggcaagtgtgagaagggactggataatgccgtcgtctccacgctgggagctctagaggctctatccgtgtcagaagaacagcagaccagtgacaattcaggtgtagccatcttgcgggcttatagtcctgagtcttcgtcagactcgggcaatgaaactaactcttctgaaatgactgagagttctgaactggccacagcacaaaaacagtcagaaaacctctcccgcatgttcttggccactcacgaaggctaccacccccttgcagaagagcagaccgagttcccggcctccaagacccccgctgggggcttgcctccaaagtcctcgcacgccctggctgctaggccagcaaccgacctcccgcccaaagttgtgccttccaagcagttacttcactcagaccacatggagatggagcctgaaactatggagactaagtcggtcactgactattttagcaaactgcacatggggtcggtggcatactcctgcactagcaaaaggaaaagcaagctggccgatggtgaggggaaggcaccccctaatgggaacacaacaggaaaaaaacagcaggggaccaaaacggcagagatggaggaggaggccagtggtaaatttggtactgtgtcttcacgagacagtcaacacctgagcacttttaatctggagagaactgcctttcgcaaggacagtcaaagatggtatgtggccactgaaggtgggatggctgaaaaaagtggattagaagcagcaacagggaaaacctttccaagagcttctggtcttggggcaagggaggccgaagggaaggaagaaggagctcctgatggagaaaccagtgatggctcaggacttggtcaaggggaccgcttcttaactgacgtgacctgtgcatcttcagccaaagacttagataacccagaggacgctgactcgtccacctgcgaccatccttccaagcttcctgaggctgatgagagtgtggcccgcctttgtgactaccacttggccaagcggatgtcatcactgcaaagcgagggccatttttctctgcagagctcccaaggctcttcagtggatgcaggctgtggcacaggcagcagtggcagtgcctgtgccacacccgtggagtcgccgctctgcccctccctggggaagcacttgattcctgacgcttctgggaaaggcgtgaattacattccttcagaggagagagcccctgggcttcccaaccacggagccacctttaaggaactgcacccacagacagaagggatgtgtccacggatgacagtgcctgctctgcacacagccattaacaccgaacccctgtttggcacattgagagatggatgccatcggctccccaagattaaggaaaccacagtgtagctttgacagagcctgggaaggagagacgaggaggcatgccttcagcttggtctcaacatcctgaagctgatcccatcctgctaccatcaaacattcactcggaatcaaaggtgccaattccaaatcaagaccctaatgatttctcccaagcaaatcaggcatacggagaggctgtgagctggcggccaccggatctgagaggggggagcctcaggacacctcccagccagaaggctctgagacatagcagcagtatcctctccggatctgtcgatttggagaccttccgagagagaaccaagggtgcagtcagcttaaagtgtccaggcatcacagaagcacaggaggccagttctgaaaggcgagcagaactccccctggggaggaagctcaccaaaagtttttcccaaagctcaatgcacttgagctctgaggggaggtttcacaaaaggtccccagtggctcataaagactcaaagctgtataggacattacccttgcggaagctggagggcagcaattggagatgccggggacccttcagctattgcttcctgaaccgagggcaggatgaagatggtgaggaagaagaggagaggggagaggccaccgtccaggtctcttgcctctatagaccacagatgactcaagccatgccagaaccaagcagcccatgcctggctgtggcgattcagaagcaacgaggggagctatccagagggtcagtgctgaaggtctgggcagaagacctgcgagacccagatgacttggacttcagcaacctggcttttgatgcccggattgcaagaataaatgccctaaaggagagcacatatgcaatgcctgatgggttccttgcagcccaaaatgatgccaatgagctgctctgtctcgtcagggcaaccaaggagaagagggaggagtcacgccctgaagcgtacgaccttacactttctcagtacaagcaactgttatccattgagtccagacagttgggaagtgcctgtaggaaaatggcgatggctgagaaaagcccggaggagatgctcctagctatgacttccagctttcaagtgctctgttgcctaacagaagcttgcatgcgattagttaaagtcgtgaactcagaaacacagcggcaggaaattgtagggaagatcgatgaagtggtcataaattacatttgtctactgaaagctgccgaagcagccactggaaagaaccctggggaccctaatgttggactctcggcgcgacactcaaccaccatggccgctctcgtaagcacactgacacgttctctcaagaggcttttaaacaaataaatatggaagtcacgtcataatctacctttgcaaagccatacatgaacttttatttactttgtgtgtatgatgaacagatgtctcctttcttctctctgtatattttgttattttatataaaataggagataaaagtcacattgatgaaatgttgaaatgtactaatcagatgtattctgtttatattatacatatatatacacgtaaaagaaatatccaagaaagtgatgacatttggctatttttcatatagttaaaactccaggtatatgatgtgaaattttaaattctaccatgttagagcaaaacaatgaatcctatcccctttctttccaagtagctacttggaaaccatatcattcatatttagaagtaaaacacaaaacaaaaaagagagagaaaagaaaagaaatcacaatgtatataaaacagtacttatgttttaaaattatgatttttaagcattggaaatagcaaaaagacatttaaaattcaagaagctattatgaattactagagaatatatctgtaataaattaattttttgctcatagtatttggttactggatgctttcttccaagaatcccacatatttaatttgggtttttgctactggggctacaaattggtggggatggattctactgtgtcagcacaaatgctcttcacagtggttctagcatttaaaaaacttcccggggagaagaacagaggggatgatgggcagtttcctaggtaacacctagagttatagaatatctcattacataaaatgtatggaattaataataccaaaattaattatttgatggaaagatctgctttgactaaatgtcaaaaatctgcaaaccaaagacattatcttcccctcatcccaactcaactacgaaacttaaaattccctttagagtgataggacatttagtaaagtatttgcaaacttaaaaaaaggaacatttaatgatcatcaaaattaagtacagattcagtaatgtagaccagaccacacaccagcacctgtgagtctcatctcagatcacagctctcagcatagggcttcatgcatcaccgcctctacagaggctaaggctgccagtcaaatttggaattatagcgtagtactgggacaaaatctcaaatcttggatgttccagaaaatcagggagagatggctactgtaatcatgggagccatgagtaaatagttaagtatttattaaataaatacttaatctggattggctgataaaaatatgaaatctgaaaaaaaaaagaaagaaatggaagtggtatatttgaccagttcaagtgaaaccaatggaatgcaaagaactttccaggactgtcacatctctaaaagtaccctgcagtcataaaataaaatcgatatgtatatatgtatttcctgggtcattcagtgctcaagttacatgcactcctacttagacaggtggctccttaagaacatgatgggagtacaccaggtgcaaatatttctacttttgtagcctgctgagaaggagtcataacacagtccacaattgcaatctctctctagtcagccattccacagggactcaacaacaaaagccgcacgtggttatggatggcagcaaaggaaaggagtttaggtgtgtgttattataaataatgtttaactaaataataaaacattatttcattacaattataattataaatattggtgttttgatattgagagatattagtggtgtttactgtggaaaatcttagtaaatatcattctgtgtactaaaatcctaacctattaataggatgtgtgccctatgtcagacagtgtgctaagcatattaactatattatctcatttaatcatcacaacaatctgctggtttggacactattctctctggaggcaatatggatgagttcttacggatatggggtttggggtcagaaacatcttgattaaaattttgactctgccattttctagcccttttatgttgggaaagctactttttctagtctcaatttcctcataataaaatgaaaatcaattataagatcgatttccatagggttgtcatgagttttgagtaaaaatgtgtatgtaaagttcttaccacaatacctggcagagagtaagtattcaattaatgttagctattattatcatcataatcgttgtgttaaatatattgcccaagataatatgtgggggaatgtttgttttatatgcatattgtatcctgactgtgtgcagaacacattatgtgtattgcatatatgtaaaagaagtgtacaaggaagtggccatccttgttcaagttacgtatctagttagaacaacttcccagtccattggagttctttgagaagcctcagggaagtagctctgggtccttctaatcaacctcccattactgcgccagtaagtttctgtttcttataaataaactctttgctattcagaaaacctcaaggggcccccacattcactaagcatggggctcctaactggggtccaggtccatagagtgtaggaagaacatattagaacaatacttgtgcttatttttatctagcttttttatgtttgtgtatgttttataatggcataatagtacaatggtacatgtacataattttaaataaataaatgaatgaatgaataaataa

SEQ ID NO: 7769 - DNA, 1403 bp, Homo sapiens
  ENST00000640291
cagccattaacaccgaacccctgtttggcacattgagagatggatgccatcggctccccaagattaaggaaaccacagctttgacagagcctgggaaggagagacgaggaggcatgccttcagcttggtctcaacatcctgaagctgatcccatcctgctaccatcaaacattcactcggaatcaaaggtgccaattccaaatcaagaccctaatgatttctcccaagcaaatcaggcatacggagaggctgtgagctggcggccaccggatctgagaggggggagcctcaggacacctcccagccagaaggctctgagacatagcagcagtatcctctccggatctgtcgatttggagaccttccgagagagaaccaagggtgcagtcagcttaaagtgtccaggcatcacagaagcacaggaggccagttctgaaaggcgagcagaactccccctggggaggaagctcaccaaaagtttttcccaaagctcaatgcacttgagctctgaggggaggtttcacaaaaggtccccagtggctcataaagactcaaagctgtataggacattacccttgcggaagctggagggcagcaattggagatgccggggacccttcagctattgcttcctgaaccgagggcaggatgaagatggtgaggaagaagaggagaggggagaggccaccgtccaggtctcttgcctctatagaccacagatgactcaagccatgccagaaccaagcagcccatgcctggctgtggcgattcagaagcaacgaggggagctatccagagggtcagtgctgaaggtctgggcagaagacctgcgagacccagatgacttggacttcagcaacctggcttttgatgcccggattgcaagaataaatgccctaaaggagagcacatatgcaatgcctgatgggttccttgcagcccaaaatgatgccaatgagctgctctgtctcgtcagggcaaccaaggagaagagggaggagtcacgccctgaagcgtacgaccttacactttctcagtacaagcaactgttatccattgagtccagacagttgggaagtgcctgtaggaaaatggcgatggctgagaaaagcccggaggagatgctcctagctatgacttccagctttcaagtgctctgttgcctaacagaagcttgcatgcgattagttaaagtcgtgaactcagaaacacagcggcaggaaattgtagggaagatcgatgaagtggtcataaattacatttgtctactgaaagctgccgaagcagccactggaaagaaccctggggaccctaatgttggactctcggcgcgacactcaaccaccatggccgctctcgtaagcacactgacacgttctctcaagaggcttttaaacaaataa

SEQ ID NO: 7770 - DNA, 7916 bp, Homo sapiens
  ENST00000616992
tttccagccacaggacgaagtcttcaggctggccgcctccctcgggaacctggggcttgagccaggtgccgccctatggatgggagatgacggcaaaccgagatgggcgagactacttcatcaatcacatgacacaggcaatcccttttgacgaccctcggttagagagctgccaaatcatccctccggctcctcggaaggtggagatgagaagggaccccgtgctgggatttggttttgtggcaggcagtgaaaagccagtggtcgttcgctcagtaacaccaggtggcccctctgaaggcaagctgatcccgggagatcagattgtaatgattaatgatgaaccggtcagcgctgcacccagagagcgggtcatcgatctggtcagaagctgcaaagaatcgatactcctcactgtcattcagccttacccttctcccaaatcagcatttattagtgctgcaaaaaaggcaagattaaagtccaatcctgtcaaagtacgcttctctgaggaggtcatcatcaacggccaagtgtcggaaactgttaaggacaactcacttctttttatgccaaatgttttgaaagtctatctggaaaatgggcagaccaaatcatttcgttttgactgcagcacttccattaaggatgtcatcttaacccttcaagagaagctctccatcaaaggcattgaacacttctctctcatgctggagcagaggacagaaggggctggaacgaagctgctcttgcttcatgaacaggagactctaactcaggtgacacagaggcccagctcccataagatgagatgtcttttccgaattagcttcgtcccaaaagatccaattgaccttttaaggagagatccagttgctttcgagtatctctatgttcagagttgtaacgatgtggttcaggagcgatttgggccggagctgaaatatgacatagccctgcggctggccgcattacaaatgtacattgcaaccgttaccaccaagcaaacgcagaaaatctccctcaaatacatcgaaaaagaatggggattagagacttttcttccctctgctgtgctgcaaagcatgaaagagaagaacataaagaaagcactttcacaccttgtcaaagcaaatcaaaacttggtaccaccgggtaaaaagctctctgcactacaagccaaggtccattatctcaagttcctcagtgacctacgattgtatgggggccgtgtgttcaaggcaacattagtgcaggcagaaaagcgctcggaagtgactctcctggttgggccccggtatggcataagccatgtcatcaacaccaaaaccaatctggtggctcttttagccgactttagccacgtcaacaggatcgaaatgttttccgaggaggagagcttggtgcgggtagaactccacgtgctagatctgaaacctatcacgcttctgatggaatcctcagatgccatgaacctggcctgcttgacggctggatactaccggctgcttgttgattccaggaggtcgatatttaacatggccaacaagaaaaacacagcgacccaggaaacaggacctgaaaacaaggggaagcataacctccttggcccagattggaactgtataccccaaatgaccacctttattggcgaaggggaacaagaagcccagataacatacatagattcaaagcagaagacggtggagatcacagacagcaccatgtgtccaaaagagcaccggcacttgtacatagacaatgcctatagttcagatggacttaaccagcagctgagccagcccggggaggccccctgtgaggcagactacagaagtctagctcagcggtccctattgaccctctcaggaccagaaactctgaagaaagcacaggaatctccgagaggagctaaagtgtcctttatttttggagacttcgccttggatgatggtattagtcccccaacccttggctatgaaacgctactagatgagggtcctgaaatgctggagaagcagagaaatctctacattggcagtgccaatgacatgaagggcctggatctcactccagaggcagagggcatccagtttgtggaaaattctgtttatgcaaacataggcgatgtgaagagcttccaggccgcggaggggatcgaggaacccctcttgcatgacatctgttatgcagaaaacactgatgacgcggaggacgaggacgaggtgagctgcgaggaggacctcgtggtgggggagatgaaccagccggccatcctcaacctgtctgggtcaagcgatgacatcattgacctcacatccctgccccctccagaaggtgatgacaatgaggatgacttcctgttgcgttccttgaacatggccattgccgcacccccacctggctttagagacagttcagatgaagaggactctcagagccaggcagcttccttccccgaggacaaggagaaaggcagcagcctgcaaaatgatgagatccccgtgtccctcattgacgctgtgcccaccagcgccgaaggcaagtgtgagaagggactggataatgccgtcgtctccacgctgggagctctagaggctctatccgtgtcagaagaacagcagaccagtgacaattcaggtgtagccatcttgcgggcttatagtcctgagtcttcgtcagactcgggcaatgaaactaactcttctgaaatgactgagagttctgaactggccacagcacaaaaacagtcagaaaacctctcccgcatgttcttggccactcacgaaggctaccacccccttgcagaagagcagaccgagttcccggcctccaagacccccgctgggggcttgcctccaaagtcctcgcacgccctggctgctaggccagcaaccgacctcccgcccaaagttgtgccttccaagcagttacttcactcagaccacatggagatggagcctgaaactatggagactaagtcggtcactgactattttagcaaactgcacatggggtcggtggcatactcctgcactagcaaaaggaaaagcaagctggccgatggtgaggggaaggcaccccctaatgggaacacaacaggaaaaaaacagcaggggaccaaaacggcagagatggaggaggaggccagtggtaaatttggtactgtgtcttcacgagacagtcaacacctgagcacttttaatctggagagaactgcctttcgcaaggacagtcaaagatggtatgtggccactgaaggtgggatggctgaaaaaagtggattagaagcagcaacagggaaaacctttccaagagcttctggtcttggggcaagggaggccgaagggaaggaagaaggagctcctgatggagaaaccagtgatggctcaggacttggtcaaggggaccgcttcttaactgacgtgacctgtgcatcttcagccaaagacttagataacccagaggacgctgactcgtccacctgcgaccatccttccaagcttcctgaggctgatgagagtgtggcccgcctttgtgactaccacttggccaagcggatgtcatcactgcaaagcgagggccatttttctctgcagagctcccaaggctcttcagtggatgcaggctgtggcacaggcagcagtggcagtgcctgtgccacacccgtggagtcgccgctctgcccctccctggggaagcacttgattcctgacgcttctgggaaaggcgtgaattacattccttcagaggagagagcccctgggcttcccaaccacggagccacctttaaggaactgcacccacagacagaagggatgtgtccacggatgacagtgcctgctctgcacacagccattaacaccgaacccctgtttggcacattgagagatggatgccatcggctccccaagattaaggaaaccacagtgtagctttgacagagcctgggaaggagagacgaggaggcatgccttcagcttggtctcaacatcctgaagctgatcccatcctgctaccatcaaacattcactcggaatcaaaggtgccaattccaaatcaagaccctaatgatttctcccaagcaaatcaggcatacggagaggctgtgagctggcggccaccggatctgagaggggggagcctcaggacacctcccagccagaaggctctgagacatagcagcagtatcctctccggatctgtcgatttggagaccttccgagagagaaccaagggtgcagtcagcttaaagtgtccaggcatcacagaagcacaggaggccagttctgaaaggcgagcagaactccccctggggaggaagctcaccaaaagtttttcccaaagctcaatgcacttgagctctgaggggaggtttcacaaaaggtccccagtggctcataaagactcaaagctgtataggacattacccttgcggaagctggagggcagcaattggagatgccggggacccttcagctattgcttcctgaaccgagggcaggatgaagatggtgaggaagaagaggagaggggagaggccaccgtccaggtctcttgcctctatagaccacagatgactcaagccatgccagaaccaagcagcccatgcctggctgtggcgattcagaagcaacgaggggagctatccagagggtcagtgctgaaggtctgggcagaagacctgcgagacccagatgacttggacttcagcaacctggcttttgatgcccggattgcaagaataaatgccctaaaggagagcacatatgcaatgcctgatgggttccttgcagcccaaaatgatgccaatgagctgctctgtctcgtcagggcaaccaaggagaagagggaggagtcacgccctgaagcgtacgaccttacactttctcagtacaagcaactgttatccattgagtccagacagttgggaagtgcctgtaggaaaatggcgatggctgagaaaagcccggaggagatgctcctagctatgacttccagctttcaagtgctctgttgcctaacagaagcttgcatgcgattagttaaagtcgtgaactcagaaacacagcggcaggaaattgtagggaagatcgatgaagtggtcataaattacatttgtctactgaaagctgccgaagcagccactggaaagaaccctggggaccctaatgttggactctcggcgcgacactcaaccaccatggccgctctcgtaagcacactgacacgttctctcaagaggcttttaaacaaataaatatggaagtcacgtcataatctacctttgcaaagccatacatgaacttttatttactttgtgtgtatgatgaacagatgtctcctttcttctctctgtatattttgttattttatataaaataggagataaaagtcacattgatgaaatgttgaaatgtactaatcagatgtattctgtttatattatacatatatatacacgtaaaagaaatatccaagaaagtgatgacatttggctatttttcatatagttaaaactccaggtatatgatgtgaaattttaaattctaccatgttagagcaaaacaatgaatcctatcccctttctttccaagtagctacttggaaaccatatcattcatatttagaagtaaaacacaaaacaaaaaagagagagaaaagaaaagaaatcacaatgtatataaaacagtacttatgttttaaaattatgatttttaagcattggaaatagcaaaaagacatttaaaattcaagaagctattatgaattactagagaatatatctgtaataaattaattttttgctcatagtatttggttactggatgctttcttccaagaatcccacatatttaatttgggtttttgctactggggctacaaattggtggggatggattctactgtgtcagcacaaatgctcttcacagtggttctagcatttaaaaaacttcccggggagaagaacagaggggatgatgggcagtttcctaggtaacacctagagttatagaatatctcattacataaaatgtatggaattaataataccaaaattaattatttgatggaaagatctgctttgactaaatgtcaaaaatctgcaaaccaaagacattatcttcccctcatcccaactcaactacgaaacttaaaattccctttagagtgataggacatttagtaaagtatttgcaaacttaaaaaaaggaacatttaatgatcatcaaaattaagtacagattcagtaatgtagaccagaccacacaccagcacctgtgagtctcatctcagatcacagctctcagcatagggcttcatgcatcaccgcctctacagaggctaaggctgccagtcaaatttggaattatagcgtagtactgggacaaaatctcaaatcttggatgttccagaaaatcagggagagatggctactgtaatcatgggagccatgagtaaatagttaagtatttattaaataaatacttaatctggattggctgataaaaatatgaaatctgaaaaaaaaaagaaagaaatggaagtggtatatttgaccagttcaagtgaaaccaatggaatgcaaagaactttccaggactgtcacatctctaaaagtaccctgcagtcataaaataaaatcgatatgtatatatgtatttcctgggtcattcagtgctcaagttacatgcactcctacttagacaggtggctccttaagaacatgatgggagtacaccaggtgcaaatatttctacttttgtagcctgctgagaaggagtcataacacagtccacaattgcaatctctctctagtcagccattccacagggactcaacaacaaaagccgcacgtggttatggatggcagcaaaggaaaggagtttaggtgtgtgttattataaataatgtttaactaaataataaaacattatttcattacaattataattataaatattggtgttttgatattgagagatattagtggtgtttactgtggaaaatcttagtaaatatcattctgtgtactaaaatcctaacctattaataggatgtgtgccctatgtcagacagtgtgctaagcatattaactatattatctcatttaatcatcacaacaatctgctggtttggacactattctctctggaggcaatatggatgagttcttacggatatggggtttggggtcagaaacatcttgattaaaattttgactctgccattttctagcccttttatgttgggaaagctactttttctagtctcaatttcctcataataaaatgaaaatcaattataagatcgatttccatagggttgtcatgagttttgagtaaaaatgtgtatgtaaagttcttaccacaatacctggcagagagtaagtattcaattaatgttagctattattatcatcataatcgttgtgttaaatatattgcccaagataatatgtgggggaatgtttgttttatatgcatattgtatcctgactgtgtgcagaacacattatgtgtattgcatatatgtaaaagaagtgtacaaggaagtggccatccttgttcaagttacgtatctagttagaacaacttcccagtccattggagttctttgagaagcctcagggaagtagctctgggtccttctaatcaacctcccattactgcgccagtaagtttctgtttcttataaataaactctttgctattcagaaaacctcaaggggcccccacattcactaagcatggggctcctaactggggtccaggtccatagagtgtaggaagaacatattagaacaatacttgtgcttatttttatctagcttttttatgtttgtgtatgttttataatggcataatagtacaatggtacatgtacataattttaaataaataaatgaatgaatg

SEQ ID NO: 7771 - DNA, 2678 bp, Homo sapiens
  ENST00000287474
atactgctgggattacaggcgcccgccaccacgcccggctaattttttgtatttttagtagagacggggtttcactgtgttggcaaggatggtctctatctcctgacctcgtgatatgcccgcctccgcctcccaaagtgctgggattacaggcttgagccaccgcgtctggcctatttatttattattttcgagacggagtgttgctcttgtggcccaggctggagtgcaacggcgggatttcggctcactgcaacctctgcctcccgggttcaagcaattctcctgcctcagcctcctgagtagctgggattacaggcaggcaccaccacacccggctaattttgtatttttagtagaaacggggtttctccatgttggtcagtctggtttcgaactcccagcgtcaggtcatctgcctgcctcggcctcccaaagtgctgggattacaggcgtgagccaccgcgcccagccacttctgtatttttaaaaaagtggtaaggaagtggaggattaaatgatttgcccaaagtctcacagtaatttgtagagctgagattgaaattcgggtgaaacttcacatatcacattctttttatcagatggcagtttctggatttactcttggtacctgcatacttctgttgcacattagttatgtggctaattatcccaatggaaaagtaacacagtcatgccatggaatgattcctgaacatggtcatagtccacagtctgttcctgttcatgacatttacgtgagtcagatgacattcaggccaggagatcagattgaagttactttgtcagggcatccatttaaaggctttctcctagaagcgcgtaatgctgaggatctgaatggccctcctattggctccttcacattgattgacagtgaagtgtcacaacttttgacctgtgaagatatacagggatcagcagtgagtcacagaagtgcatctaaaaaaacagaaattaaagtctactggaatgctccaagcagtgctccaaatcacacacagtttctagtcacagttgttgagaagtataaaatctactgggtgaagattcctggtcctataatttcacaaccaaatgcatttccttttacaacacctaaagctacagtagtacctttgccaacgttacctcccgtttcccacttaaccaaaccattcagtgcctcagattgtgggaacaagaagttctgtattaggagtcctttgaactgtgacccagagaaggaggcttcctgtgtcttcttgtccttcacaagagatgaccaatcggtgatggttgaaatgagcggccccagtaaaggctatttatcctttgcattgtctcatgatcagtggatgggtgatgatgatgcttatctgtgtattcatgaagatcagactgtgtacatccagccttcccatttaacggggcgaagtcaccctgtaatggactccagggatacccttgaggatatggcttggaggttggcggacggtgttatgcagtgttctttcagaagaaacattacccttcctggagttaagaatagatttgatctaaacacaagctattacatatttctagcagatggtgcagctaatgatggtcgaatttacaagcactctcagcaacctttgattacctatgaaaaatatgatgtgacagactctccaaagaacataggaggatcccattctgtactccttctgaaggttcatggtgccttaatgtttgtggcatggatgactactgttagcataggtgtactggttgcccggttcttcaagccagtttggtcaaaagctttcttgcttggtgaagcagcttggtttcaggtgcatcggatgctcatgttcaccacaactgtcctcacctgcattgcttttgttatgccgtttatatacaggggaggctggagtaggcatgcaggttaccacccatacctcggctgtatagtgatgactttggcagttcttcagcctcttctggcagtcttcaggccacctttacatgacccaagaaggcaaatgtttaactggactcattggagtatgggaacagctgctagaataatagcagtggcagcgatgttcctgggaatggatttaccaggactgaatcttcctgattcatggaaaacctatgcaatgaccggattcgtagcctggcatgttgggactgaggttgttctggagttgaaatattggatgatgacagaattcagatccttcagtcatttactgcagtggaaacagagggtcatgcttttaaaaaggcagtgttggcaatttatgtctgtgggaatgttacttttctcatcatatttttatctgcaatcaaccatctatgagcaagcaaagaccttggcttttgcaggccaagtgataattatcatcaaaccaaagaaacttgaagcctgtcctgactgcctggagcatatttgtgaattctcacttggaagactggggtcatgtctgtagaggaattctgaagtccagcctttagagaacaacattcaagagggtcatatagactataaattaatgtcatgccctatatgtaattctgggtcttaaaggaaagattgtacttcaggagaagtaactctcaaatatttcatgccaagattttaagaatgttggtatttaagaaaataaatagtgatttggaaaatc

SEQ ID NO: 7772 - DNA, 216 bp, Homo sapiens
  ENST00000489209
gttaccacccatacctcggctgtatagtgatgactttggcagttcttcagcctcttctggcagtcttcaggccacctttacatgacccaagtggcagcgatgttcctgggaatggatttaccaggactgaatcttcctgattcatggaaaacctatgcaatgaccggattcgtagcctggcatgttgggactgaggttgttctggaggtacatgct

SEQ ID NO: 7773 - DNA, 440 bp, Homo sapiens
  ENST00000492943
tcatgttcaccacaactgtcctcacctgcattgcttttgttatgccgtttatatacaggggaggctggagtaggcatgcaggttaccacccatacctcggctgtatagtgatgactttggcagttcttcagcctcttctggcagtcttcaggccacctttacatgacccaagaaggcaaatgtttaactggactcattggagtatgggaacagctgctagaataatagcagacttaaaacaatctggaaaatgtgggtgcatctcttttaaggattggtagattacgcagccataaaaaagaatgaagtcatgtcttttgtagcaacatggatgctgctggaagtgattatcctacatgaattaatgcagaaacagaaaatcacataccacatgttctcacttataaattggcagcgatgttcctgggaatggatttacc

SEQ ID NO: 7774 - DNA, 1304 bp, Homo sapiens
  ENST00000370176
ggttaggctgccttcgcttctcaaggtaaggaagtggaggattaaatgatttgcccaaagtctcacagtaatttgtagagctgagattgaaattcgggtgaaacttcacatatcacattctttttatcagatggcagtttctggatttactcttggtacctgcatacttctgttgcacattagttatgtggctaattatcccaatggaaaagtaacacagtcatgccatggaatgattcctgaacatggtcatagtccacagtctgttcctgttcatgacatttacgtgagtcagatgacattcaggccaggagatcagattgaaggtaccgtgctgggattaactgtttacattttggatttcactcttttactgtttattgaatctttattattacttgatttagaagatttcacttaaatctgttttcttttgtaagatactatcatacttcttatttttggttccagatgactgtattacttaagtagtctgtgtattccccatccagaacaggctttaaaataagtttttatcgttatttactatttttattaattgtgctatcacttcaagagaagagaaaaatgaagtttattttatcttgtttaaaatataataaacccttgtccttcttgatatcatataattttaagaacaattctctaatttctctggtaaaatgtaggctgattattaaagataaatctataacagcattttgcaaactattttttgcaactctagaaatgcaaaatgttaacaggtactctgttacatagagagtatatagaaaaataagtttggaatattctgtgtgatatataatataccttagagttcacactgtacagtaggatattaaatatcctaagaaatttgcagtaaagaaacaagtatttactttcatccagtgtttttctttttttgtaattcaataagaatttattgagtgtcactgtgagccagacactgtgttaaatactgcaattcaaaagaaaacacctcatgttttttcctctaatgaggtcaagtaaacattttttttttaaacttttattttgggttcaggggtacatgtgtaggtttgtttataggtaaattccatgtcacgagggtttggtgtacagattatttcatcactcaggtgataagcatagtacccaattggtatcatctagcattttccaaactaacttagccttatggactgcccctggaccatcacctatttttcttttctctttgcggaatggctattaatatctcacagattgaatatcttatggaacactggaaaaaa

SEQ ID NO: 7775 - DNA, 8197 bp, Homo sapiens
  ENST00000561981
atgcgcagaccgaggcagggaggcgggggtgcgggaggctccgcggctgcgcgggcgcgtgctggtggcctcggcggaggctcagtcccggcccgcgcccgcggcgcccccgctgcggcccgagcggcctggctgcgggatctgtgcgcacggatggcgcggccgccccggcagcacccgggggtctgggcgtcgctgctcctgctgctactgacggggcccgccgcctgcgcagccagccccgcggacgacggtgcgggcccggggggccggggaccccggggacgcgcgcggggggacacgggcgccgacgaggcggtgccgcgccacgactcctcctacggcaccttcgcgggggagttctacgacctgcgctacctgtcggaggagggttaccccttccctactgctcctcctgtggatccatttgccaaaatcaaagtggacgactgtggaaaaactaagggatgctttagatatggcaaaccaggctgtaatgcagagacctgtgactatttcctcagctaccggatgataggggctgatgtagaatttgagctgagtgcagacacagatggttgggtagcagttggattctcttcagacaagaaaatgggtggtgatgatgtcatggcctgcgtccatgatgacaatggcagggtccgcatacagcacttctataatgtaggccagtgggcaaaggagattcagagaaaccctgccagagatgaagaaggagtttttgagaacaatcgcgtcacctgcagatttaaacgccctgtgaatgttcccagagatgaaacaattgttgatctgcatttgagttggtattatctgtttgcttggggtccagccattcagggctctatcactcgacatgatatagactcaccgccggcttcagagcgtgttgtcagtatttacaagtatgaagacatttttatgccatcagctgcctatcaaaccttctcatctccattttgtttgcttctgattgttgctctgaccttctacctattgatgggaaccccctaaccacagctgcagggccaacagattacatggattgggaagtctttagtataaatatattttttaaagaatatccagtataattttagcttcaattatttaagaaaaaaaacctcatataatttcagctttttggaagaaagaacaagcttcttttgtagtcaaagaagattgtttaataatgaccctatacttttggaacatacttacaccttttctaagcactttcacatatgttttcttatttaacttcacaacatctctgagttggattgatgaaaattgtgattgccatcttcctgaatgggatttgagacccaaaaagactgcctttttatgatccacataccatataactttggctagaaatgacaaatagaaaggcagagaaggaactaagtatagaaatcatgtctcaaaacagtctttactatgagtgctatagcacagagagttattttgaatattactagggagaactttactgaatgtcataagttcacagtcagccttttgggcagaagaaatttcaaatttccgtaaagcagaagtgcttttggatatttacacagccaatggggagattggaggaaaatacaatgatatgaaaatagttcatatttatttgaaattttggccgagcatggtggctcacgcctgtgatcccagcactttaggaggccaagacgggcaggtcacctgaggtcaggagttcgagaccagcctggccaatgtggtgaaacccccgtctctattaaaaagtacaaaaatgagccaggcgtggtggtgcacacctataatcccagctattcgggaggctgaggcaggagaattgctggaacccaggaggcggaggttgcagtgagccgagattgtgccagtgcactccagcctaggtgacagagccagactctgtctcaaaaataactaactaaataaataatatttatttgaaatttcttctcagttagagagcagctatgggaaaacatttttactgctatttgcaaaggttggagaccaaactgtgagcattcctgaagatgtaaagttgtgttaatgatattaaaaaaaaaaaaaaagggaattcttagcagttagaatttgaacttttctaccactgaattttataaaactaaggtattcatctgtggttacagtgaattctcttgtcagagccagcataccttaagtgtgattaaaaatgtatttttttttttttttgcgatgaattttccctcttgtcgcccaggctggagtacaatggtgtgatctcagcttcactgcaacctccgcctcccaggttcaagtgattctcctgcctcagcctcctgagtagatgggattacaggcatgtgccactatgcctggctaatttttttgtatttttagtagagatggagtttcaccattttagtcaggctggtctcgaactcctgacctcaggtgatccacctgctttggcctcccagagtgctaggattacaggtgtgagccaccgtgcctggcctaaaaatgtgttatatcagacaaaacatcttagtaaaaatttagggcattttaataataagccaacagtttttgagactgtagagattttgagtagaattttttttatgaggtggctttttaaaaaataattgaaaatgggaaaatgacccataaagtgaattcacctagaatatccatttaaatgttcagacttgtggctgagcgcggtggctcacacctgtaatcccagcactttgggaggccaaggcaggcggatcacctgaggtcaggagttcgagaccagtctggccaacatggcaaaaccttgtctccactaaaaatacaaaaattagccgggtgtggtggcacatgcctgtaatcccagccacttgggaggctgaggcacgagaatcacttgaaccttggaggcagagcttgcagtgagccaaaattgtgccacttgcactccagcctgggtgacagagggagaccctgtctcaaaaaaataagtaaaataaaatgttcagacttataaactagacaggtagtcagcataattcatagtaatgccttgacattaggcgccccaaaggactcctttgttctttgttccaaatgtctgtgctaactgcccattttgaggagagaagtctgcaggtatagttagtgctgctgagacatttccactctggcattctagagttctctggcttgcccttgttgctttaaagctggttccaacttcgtgggctttatgattgagcaacactggtgattgtgatttctaataccaccctccagattcatgtcacaggtgaaagtctgcctgtggggagagctttcacattctcctggagttgaaccaaaataaggaaaacatcaacaaacacagttaccaaaagcttccaaggagggatggaggagaaattctgttcattgcagatggggagaaattaaatgacatcaagtgcataatggaactgggtaggattcaaactcaagtcccctggttcaagtccttgactccactctgggcatggctaagtctggcctgtgtctcatcttctcagctctagtggctgtttagtagtgaagatactgatatgcaggcagccatgttgtaaataagaagcaaatatttttatatttctctctcttatgtgtataatatttgagctacaaacaggttaaaacaaaagagagacttcagcttagtagcaggcagggaaggaagaagtgaatgcagcttccttccgcttacatttctaatcaagctaattatttcactagtgatttctcatttgattaccgattttgcttatttatgcttagaactttcaatgacttctcagtgccattaaggtaaaatgcaagccatttctgtgacctgcaatatcatcttttgccactcctcctcacttgctatgtcttagcaagactgagaggctctcagttcttcagacctgctctatctcacctctcattttgttcatattctccacctcttgtgcttgatgaactcctattcacctatcaggtcacaacttaaatattttttcctccaaatctctggactacataggtccaggcccccatcaaatgctcccatagcacattgggcttcctcatcaacatgctcgttatacttttctagaattgctggcttgtcctccttgttatctccctaatgcagagaccattactcatcattgtagcagatatttatccatatcaggtactcagcaaacatttgtggaatgaatctatatgtgaaactatacttctatggcaagtttgtttggttcagaaggcttgcatttcatgtatattgggagactggccaacatttttatattcttcctcctatgctcaaaccataaataattatgttagcaaacactgaactttgtcttttgaaacataaatagaaacatccttagtaacagtactaacagtaatcatttttcagaaataagaattcacaccagtgatacagaatggcctttgaccattatctcagagaactagcagtcgatagacatgctgaagtgataattccaaaaacttcagtttcattcatccctacttaaatataagagaatcaacttctattttatgtctgtattcccattttctaatatactacttgtcacagaggagatgcccaaccagtgtttttcgtaaagtacctgaatagattaataataatgctagtgaaatatatttagtgctgttctaagcactttacatgaattaactcatttaatcctcaccgcaaccataggaagtagattctattatttatccaattttacagatgaaaaaactgaggctggtcacttgacataaattaccagtgctggccaggactttagagaccatttaatccaatgctcttattttacagaggtgcagctgaagcctaaggaggtgatatgatttcctacacattcatgcaccttcgtgcacatccattaaaacttttattaaatggaacccactatccatactccaattagctaggtgccttttttcccccatttagtaatttacaattaattggaggactttttatagttatatttagaggaaaggagcatgttttactctatatcaactttcttttctgcttaaaagcattttgattctttattttaccagtcattttagttcttttaataggtttaatacacagatcaaacaagacttaaatacatttttaacaatgtaacaatttaaaagaaattgcctaaaacctaggtcttctaacttggagcccagtgctttttttattgctccgctgagtcaaaaggtgaatatataaacatgatttcagatagaatgcagaagctgtatttaattaagttggcttttgtcattaaagaaatcagaaagtttggacaactcaggaatggatttccatcctagatggtatttactactatttctggaattaagtttactgtctatattcaggattttgtgcataagagacgtgaccactgaggttgtgtgtcattcttatctctactccaggggtcagcaaactttctctgttaagggtcagatagtagttttttggcttttcagtctctgtttggctctgctataaacaatacataaatgaatgagcatggctatgttccaataaaacttaattgacactgaactttgaatttcatgtacttttcaaatgtcacaaatgttttccttttgatttttttcagaaagccattaaaaaaatccaaagaccattcttagcttgcaggctgcacaaaaacaggaagcaggcggggtttgcttatggactgtggctttcccacccttgttcttagatagggacacaccaatatatcatgattagttgtaaaggatactgccagtaacatattattactggttagttgtaagaatatcaaagttagtgaataatttgcttttaaaataaattattgttgatttatttttataaataaatggcacagggcatctcatgctcttgcattctaatatattttctggaattgatgcaaaagtggtggcagtaaagtacagagccggctaagcagcagttttgtcttaagtaactgtggtgatcatggacaaccattgcgctgaactgctcttcatggtaaggatttcagtgtttcagagtaattcattaacctagagatgttttaaaaagttgtatcggccgggcgcggtggctcaagcctgtaatcccagcacttcgggaggccgaggtgggcggatcacgagatcaggagatcgagaccatcctggctgacacggtgaaaccccatctctactaaaaatacaaaaaaaattagctgggcgtggtggcgggagcctgtagtcccagctactcaggaggctgaggcaagagaatggcgtgaacccgggaggtggagctttcaatgagccgagattgcccctctgcactccagcctgggtaacagagcaagactccgtctaaaaaataaataaataaaataaaataaaataaaataaaagttgtatcaaaatctgctgcaccatgggagtgttttacacatgtgatgtggcatctaccttatgtaccataatggaaaaatgtttgagaaccactgcactaggccaaaggctgggatgtgtatactttgctgccgtgtataattgtatgtccttgttctctaaacggaattggttatgtttagtgaacagttaggtggttctccatgtgtttatatacacagacgatccccgaatttggatggttcaacttaagagttttcaaacttacgatgatatgaaagtgatatacatttgatacattcctacaacttacaatggggttatgtcccataattgttttgacttatgatattttcaacttacaattgatgggtttactgagacataaccctcttgtaacttgaggagcatgtgtatatttgtacatacatgatggtgtgtgtttatacacaaaggcctgaatatacacaccatgagcatttgaaggtctttgtcaaggttgtttctgtttctgatctcttgcctactttaaaacccaagaggtagaacattatgcatattacaggcaaaactatgcttgagtttatagcaatgtagtttgtagaaaggattcctggatgttttactaagcctttcctcctccattcaacattatatgaattgttaagaacatataaagtaccactgttgaatgtgacttttctatactgttagttaagaaaccaagactagtgttagctgagtaactggcatgttgatgcaacctatacaggttttgtatttaattaggttccttattcagttattcaagtatccagttatttagtttcaaggtagatttctttgtttttatatttaataaaagacttgcatataagttcctcttcatgaaaatagtggctaggctagtgtgattttaagtatgtctggcaactcaaaatgtaatggattcatcaagctatttgggatttttaacataaaacacactgctgcttgattaatgtgttcagttttcccctggatatttgctattaggctgatagccatttggttggattcttctggagagtaattgattctctaaggtaatggggtgctgcagtgggtgtagcattcacccaggtcactagaatcctacctgtttcatcacatagaaggccctggccatggggaagagtgaatgcagcttctccggatgccttatttccacagacatgctgatatgctggaacaatctggctccaggagtattaatatacttttttgagactgtctacaaaatactattttgtaaaaactatgcctttacatagacattgataggttatatttgttttataacaattgtgtacctaatgtttgtgattaattttgagatttatgtatatttataagcctatcttatgtaaatttttactctaagatgtgtggcacattactaataaagacgtggatttctatttatgtaaagtaattgtagcaatattcctagatgctacctaaatgattgttctgtccatttgccatcacaaatacttttatctttggatgattatgttagtcagaatatattaattagatttaaactttaaaataagaattacaacatagtttgaaattcttcctgttgatgtaattaaagttagtttataattcctta

SEQ ID NO: 7776 - DNA, 10697 bp, Homo sapiens
  ENST00000642040
agggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatacttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacaaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaaaagcgatgaacaacagcgagattatttaatggaaagacgggacctcgccattgattttattttttctttagtattaatagaagttttgaaacagattccacttcatcctgtaatagacagtttaatacatgatgttattaacttggctttcaagcactttaaatacaaagaagggtaccttggtcccaacactggcaatatgcatattgtggcagacctgtatgcagaagtcattggagtgttggcacaagccaaattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggaatgtgcacattacttcctcgaggtcaaagacaaagatatcaagcatgccttggctgggctttttgttgaaatacttgttccagttgctgctgctgttaaaaatgaagtaaatgttccctgccttagaaattttgtggaaagcctgtatgacaccacgctggaactttcttctcgaaagaagcattccttggccttgtaccccctggtgacctgtttgctctgtgtcagtcagaagcagctgttcctgaacaggtggcacattttcctcaacaactgcttgtccaaccttaaaaacaaagatcccaagatggctcgagttgcactggaatctctctacagattactttgggtttacatgattcgaattaaatgtgaaagcaacacagctactcagagccgacttataaccatcatcacaacacttttccccaaagggtcccgcggtgtggtaccaagggacatgcctctgaacatctttgtgaaaatcatccagttcattgcccaggaacgtttagattttgcaatgaaagaaatcattttcgattttctttgtgtgggaaaaccagcaaaagcattcagtctcaacccagagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggcatgtccttatattactctcaagtacgaaaagctgtagacaacattttaaggcaccttgataaagaagtaggaaggtgtatgatgctgactaatgtacagatgttaaacaaagaaccggaagacatgatcacgggtgagagaaagccaaaaatagatcttttcaggacctgtgttgctgctattcctcgactgcttcctgatgggatgtcaaaacttgaacttattgacttactggctaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcacttgccctcttgtcatgtgagctggccaggatgtaccctgagctcacactccccctcttctcagaggtaagccagcgattccccacaacacaccccaacgggcgccagatcatgcttacctacctgctgccctggctgcacaacatcgagctggtggacagcaggctcctcctcccggggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagagcccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagaggaacttcagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaagcaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttag

SEQ ID NO: 7777 - DNA, 13200 bp, Homo sapiens
  ENST00000542859
agggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatacttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacaaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaaaagcgatgaacaacagcgagattatttaatggaaagacgggacctcgccattgattttattttttctttagtattaatagaagttttgaaacagattccacttcatcctgtaatagacagtttaatacatgatgttattaacttggctttcaagcactttaaatacaaagaagggtaccttggtcccaacactggcaatatgcatattgtggcagacctgtatgcagaagtcattggagtgttggcacaagccaaattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggaatgtgcacattacttcctcgaggtcaaagacaaagatatcaagcatgccttggctgggctttttgttgaaatacttgttccagttgctgctgctgttaaaaatgaagtaaatgttccctgccttagaaattttgtggaaagcctgtatgacaccacgctggaactttcttctcgaaagaagcattccttggccttgtaccccctggtgacctgtttgctctgtgtcagtcagaagcagctgttcctgaacaggtggcacattttcctcaacaactgcttgtccaaccttaaaaacaaagatcccaagatggctcgagttgcactggaatctctctacagattactttgggtttacatgattcgaattaaatgtgaaagcaacacagctactcagagccgacttataaccatcatcacaacacttttccccaaagggtcccgcggtgtggtaccaagggacatgcctctgaacatctttgtgaaaatcatccagttcattgcccaggaacgtttagattttgcaatgaaagaaatcattttcgattttctttgtgtgggaaaaccagcaaaagcattcagtctcaacccagagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggcatgtccttatattactctcaagtacgaaaagctgtagacaacattttaaggcaccttgataaagaagtaggaaggtgtatgatgctgactaatgtacagatgttaaacaaagaaccggaagacatgatcacgggtgagagaaagccaaaaatagatcttttcaggacctgtgttgctgctattcctcgactgcttcctgatgggatgtcaaaacttgaacttattgacttactggctaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcacttgccctcttgtcatgtgagctggccaggatgtaccctgagctcacactccccctcttctcagaggtaagccagcgattccccacaacacaccccaacgggcgccagatcatgcttacctacctgctgccctggctgcacaacatcgagctggtggacagcaggctcctcctcccggggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagagcccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaagcaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaagacaaaatacacgttgaccatggactttatttctggttaatgaaaatgtttgtcctgggcacacatgaagttttgcatgtgggttgccaaagtaataaccccaaggggcacccctcgcatgtatgatctgaatggcacccgtgggggtcatgccatgcatggccctgtgaagctggaggtaagtattatctctttggaagttggcatcaaaactgtgagcttcaaccaattctctgtaatcaaccaaagagaaaaatcagaaaaaagtgagagctctaattctccataacctataattaggttgtcatccttcaaatttggaagttaattctatagtgagcaggaaaaagtagtagagttgtaattctgtcaccaacacctatcccccaggaacacagggagaaacatgtaacaatctcatttatgccgtctttctactcatattttacatggaccaacaaatatagcttgctttactagcatatggctactgaatcattggcagtaatattctaggagtattctatagaagagagcctaacctaggattttttttaaatcctagtagttgctacagatgcaactactagattttaataattttctggactgctgaaaacatatttttctgatgatttatttttttcaacttgcctgaaagatgatttgctatgatttgtagaaacaactgaatcatgatctctctgaaaaatatcataaaataaaggtttctgtggctaaccacagtagacaactttcagagagttttgttgggagccacagtagaaagaacagattcgtcatgaactgagttttctaccatggcttcttacccagcagagaaccaccgtgatggtttactcttaaaaagggaaggaaaaaaaaaaaggatttcaacagtacattacaatccaagatattaacataggaagcagtggtctgtgtttttctcaattttatttttaaaaggagatgtattaatgtgaaaggtttcttctacttttcctctatctcttcacctcctctactttaagtggagatgggaaaaattgtgtaggatgcagccccacgccagcagagcccagcaataactttagatctaccagtcaaatcttgtcggctattgctctgtgcctctgttacagaagcattaatgttaattgccttccccagggatacaaagaagtagaagtaccaaaggaaagggtagatatttaacagatgcctcagtgataagaaagatgcctccttgtgtctcactgttttctagcactgaaacatgatacactttgtatccacctgcagaataaagcaatccagacaggcgctctgtaacttagacatcacttgattaaaattatagtctccaaatatagtgttttagaaaaggcactgcacatttttagaggcacgtgaatgtcattcccacctctaacccatctaacatcggtgagatgttaagaaaatgtgccgatgttactgtgaaataaagatgcctgtaattaattgtaggcatcacacacatgcgtgaacatccagagttaggtctcaaggctcttctggttctaagtcctaacaaacaatgatcttttcagtgaactgtagaattctggaaagaataagcgtacctccaggctgcttacatcaatagcttacacgtgcttcctgatgcctgccttaacaacaaaaaattcgtgtccataggtgagtattagggtatgttcattgtatctcaatgaaactagtttttaaagttttcaatgcatttgtttgagatcaattaatatttggatacctatcatgacccaggatatttctttgttcagcaaatatttattgcatgcccactctgggctaggcactgttttagaggacaccgcagctatcaaggcagatgtggtccctgttcccatgaggctcctacatttgagtggaggaagatgtacttgtctacgttgggtgatgattagtgccatgaagaacaaaacggatacagtgagtaatgtggacagggctatcttagctatcactctaataaggtgatatctgaggagagatctgaatgaagtgaggatacaatggatatccaaggaaaagagcattccagcaaaggaaaaaacacatgcagagaccctgaaggagaagcagggtcactttgtcaaagggacagcaaggaagccaatgaccgggtgaaatgagtgaagagagcgttcagagaggacagccaaaagctctgtgggccacggcaggactttgtcccttgctgagcaagatgggaagccactgaatgtttgcgggcagggtagtgacatgctgtgacttatgtttaaaaggattactccttcatagcgatgaagaaaagctctataacaaaagttccgttgtggtggttatacagcattgtgaatgtacttaatgccaatgaattgtgtactttaaaatggtaaattttatgttatatatgttttaccacaataaaaataatttttttaaa

SEQ ID NO: 7778 - DNA, 502 bp, Homo sapiens
  ENST00000463566
tcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatatgcggtgccttctggaaaccatccaccatttgcacactaccccagtgcagaagatttagcaagtaaccagttcctggaaacgcgaatggcatttgtggaacaagataagacacaacttaacctcattttctttcatactaatgtctttcatttgatagatgccattcatcatattccttttaacattgctc

SEQ ID NO: 7779 - DNA, 691 bp, Homo sapiens
  ENST00000436046
tggtatgaacagtctgccctggacggaaggcctgttttagtttgtcttctactgtaggtctttagcacctgactaaaaatacacctggggccaaaaatataagggccctgcattgtggctgagacacttatggtggcagtgagcaacaggaccatggagcccatcattatgtgttttggctttggaacatggtctgtgtagctgttccagactgttagtttgggtttcttttcaggctcatggagattacaactgcttgttggagacgatcctgtgtgatcagcttcataaaagggcttgcttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacaaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaa

SEQ ID NO: 7780 - DNA, 601 bp, Homo sapiens
  ENST00000641614
gagccaattacaatttttcgtagcacaaacaaccaaagggagaacggtttctcaggagaggactcttgattcgcaggtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgag

SEQ ID NO: 7781 - DNA, 711 bp, Homo sapiens
  ENST00000477712
gaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaagcaattgg

SEQ ID NO: 7782 - DNA, 650 bp, Homo sapiens
  ENST00000380217
catgcttgctgtgtagcaaatggaatctcttgcacaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctg

SEQ ID NO: 7783 - DNA, 437 bp, Homo sapiens
  ENST00000418076
gcgtgaacatccagagttaggtctcaaggctcttctggttctaagtcctaacaaacaatgatcttttcagtgaactgtagaattctggaaagaataagcgtacctccaggctgcttacatcaatagcttacacgtgcttcctgatgcctgccttaacaacaaaaaattcgtgtccatagcaaatatttattgcatgcccactctgggctaggcactgttttagaggacaccgcagctatcaaggcagatgtggtccctgttcccatgaggctcctacatttgagtggaggaagatgtacttgtctacgttgggtgatgattagtgccatgaagaacaaaacggatacagtgagtaatgtggacagggctatcttagctatcactctaataaggtgatatctgaggagagatctgaatgaagtgaggatacaatggat

SEQ ID NO: 7784 - DNA, 10688 bp, Homo sapiens
  ENST00000380250
agggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatacttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacaaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaaaagcgatgaacaacagcgagattatttaatggaaagacgggacctcgccattgattttattttttctttagtattaatagaagttttgaaacagattccacttcatcctgtaatagacagtttaatacatgatgttattaacttggctttcaagcactttaaatacaaagaagggtaccttggtcccaacactggcaatatgcatattgtggcagacctgtatgcagaagtcattggagtgttggcacaagccaaattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggaatgtgcacattacttcctcgaggtcaaagacaaagatatcaagcatgccttggctgggctttttgttgaaatacttgttccagttgctgctgctgttaaaaatgaagtaaatgttccctgccttagaaattttgtggaaagcctgtatgacaccacgctggaactttcttctcgaaagaagcattccttggccttgtaccccctggtgacctgtttgctctgtgtcagtcagaagcagctgttcctgaacaggtggcacattttcctcaacaactgcttgtccaaccttaaaaacaaagatcccaagatggctcgagttgcactggaatctctctacagattactttgggtttacatgattcgaattaaatgtgaaagcaacacagctactcagagccgacttataaccatcatcacaacacttttccccaaagggtcccgcggtgtggtaccaagggacatgcctctgaacatctttgtgaaaatcatccagttcattgcccaggaacgtttagattttgcaatgaaagaaatcattttcgattttctttgtgtgggaaaaccagcaaaagcattcagtctcaacccagagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggcatgtccttatattactctcaagtacgaaaagctgtagacaacattttaaggcaccttgataaagaagtaggaaggtgtatgatgctgactaatgtacagatgttaaacaaagaaccggaagacatgatcacgggtgagagaaagccaaaaatagatcttttcaggacctgtgttgctgctattcctcgactgcttcctgatgggatgtcaaaacttgaacttattgacttactggctaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcacttgccctcttgtcatgtgagctggccaggatgtaccctgagctcacactccccctcttctcaggtaagccagcgattccccacaacacaccccaacgggcgccagatcatgcttacctacctgctgccctggctgcacaacatcgagctggtggacagcaggctcctcctcccgggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagagcccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaagcaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagact

SEQ ID NO: 7785 - DNA, 6418 bp, Homo sapiens
  ENST00000334574
atgcagaggtcactaggaaggaaagcctgctgaacacagattcaattttctagcagaactccaggtcctctgagttaaaggaagcatttatggacgcttagcagggcccagatattcactattaagtgtccaggaaggatctttcttatataaaggtgcttctgaggacttccagagttacaatggaggaggaatcgggggaggaactggggctggacaggtctactcccaaggatttccacttttaccacatggacctgtatgactctgaagacagactgcacctctttccagaagagaacactaggatgaggaaagtagtccaagctgaaatggccaatgagtcaagaggagcaggggatggtaaggctcaaagagaccttcaagaggaagtggatgaacttgtccacttatatggacttgaagatgatcatgaattaggggatgagtttgttgatgaaaacatacccagaacaggggtttcagaatatcctccttatatgatgaagaggagagacccagccagggagcagagagactggagacttagtggagaggcagcggaggccgaggacctgggcttcggagggtggggctcagcaggccagtgccaggacttgcgggaagcctataggtacacacacggccgtgccagcgaggagtatgaatgctatgtcatccccgaggaagaggatgaagaagaagctgctgatgtcttctgtgtcacttgtaagactccaataagagcttttcagaaggtttttgatgaacataaggagcatgaagtgatcccactcaatgaagcactggaaagtgccaaggatgaaattcacaaaaacatgtacaaattggaaaagcagataattgagatggaaaactttgcaaatcatttggaggaggttttcatcactgtggaggagaattttggaaaacaagaacaaaactttgagtcacattacaacgagatcttggaaacacttgctcaaaaatatgaggaaaaaatacaagctctaggggagaaaaagaaagagaagctggaagccttatatggacaactggtcagctgtggagaaaacctagatacttgcaaagaactgatggaaacaatagaggagatgtgtcacgaggagaaggtggatttcataaaggatgcagtggctatggctgacagactcgggaaattcctgaaaacaaaaacagacgtggaaatctctgcacagcctgagtttgaagaccagaccttggatttctctgatgtggagcagctgatgggctccattaacaccattccagctccttctgctccagtcataaatccacaggtccctaactcagccacaggttcctcagtccgagtgtgctggagcttatactccgacgacactgtggagagctatcagctgtcctaccggccagtgcaggacagctcacctgggacggaccaagcagagtttacagtgactgtcaaagaaacatattgctcagtgacaaaccttgtgccaaatacccagtatgaattttgggtcacagctcacaacagggctggccccagcccctctagcgagcgtgcagtgtacatgacagcaccttctccccccattattaaaaccaaagagataaggagctgtgaagaggctgtgctgatttgctgggagtctgggaacctgaatcctgtggactcgtacactgtggagctgacccaggctgaaagtccagaagcctcgggtgtaactgagtctgttgtgggcatcccgacctgcgagtccgtggtgcagctgcagccggggcggagctacattatctatgtgcgagccctcaatatggggggccccagcgtgaggagcgagccagctacagtccacaccataggaagctactttcgcctaaacaaggacacttgccatccctggctgaccatttctgaagacggacttacggctgtacgaagtgaaaggagaacccccgccagggagctgtcacccagcgacactcacttcaccaggtgtgttgctgtcatgggaaatctaattccagtccgagggcaccattactgggaggtggaggtggatgagcatttggactacagagttggtgtggcctttgcagatgtccgtaaacaggaggatctgggagcaaattgcctctcctggtgcatgaggcacacatttgcatcatcaaggcataagtatgaatttctgcacaacagaacaactccagatataagaataacagttccaccaaagaagattggcattctattagactatgaacattcaaagttgtcatttttcaatgtggacctttctcagcatctatatacatttagttgtcagcttcacgaatttgtgcatccctgtttttctttggaaaagcctgggtgtctaaaggtacataatggcatttcaatgccaaaacatgtcactttctattagaacattctgatgtccagtttcctgtcttccatgcctacccctctcgcagctgctcacgccttagctggctgaacctggcacttaagcaccatgtgcccagcacaatttatggctcatgctattatctgactggtgtgctagcgctcatttcacccaacctggattctagtcctgtgtgctgctacctgtgtgctgctaggatagtcattaccaggcccagctgtaaaataaaggctcagactaaacgaactcaaaagtctttgaagctgtcaaactatattcgtgtatatgcaaaatatcttgagtttccaagacctagagagcttgggagaggacgagggtagtcttaatggctccagcagcaccagtacacccatgcatttcatgagtcagccaagaatacacttgagaaggcgagaggctgtctgtagagaaccagggaagctgtgtgcccttctcaatgtcttctaccctcgttttcccaatagtgagcagcactgtggtgaggtcccttccactgtgtactctgcatacagggtattccctgttccactcctacacagtatgcaccactctctaattttgaaattacctctataatgcctaattccatgaagggagggacagtgcctgttttgttcattgctagatcaccaagggctaacacataacagctgtcaccaagtatttgttgaataaattagtatcttcttcagccactgctctttggcctcttactgctctccatgtgaaggatggcagggctctttcaaaactacagcaaaggacctatggccaagaaatgggaaaaaacctagaatggaggcagcgtgaaagaacagaagggcatctgtggcatattagcaaatgcacaacaattttttaaaagaaattaacagcccaccaaagggcaaagctgagcacgggaaggaagactgatctctagctaggcagctttcaggcatcctgcctcactgcccccaggccattctgtgagctcaatgcccaactccatcagctacattcctggttctcctgttcaagtttccagttgccacttaagctctgcacacacagcattttcaaagcttgtgagtgaagctgcagaataattccatttgtgaagcaattacaattcagtatcatgtcccacagatgcctctaaacccagatatgccctaatctcatcatttaaggttttgtgtttaaaaaaaaaaagtccacttttcttttttctggcgaaaccccgtctctactaaaaatacaaaaaattagccgggcatggtggtgggcgcctgtaatcccagctactcaggaggctgaggcaggagaattgcttgaacccgggggcagaggctgcagtgagccgagattgtgccactgcactccagccttggcaacaagagcgcaactctgtctcaaaaacaaacaaacaaacaaacaaaaaacctctgatgttttccagcacctgcaaagtctgacaaactgaaagactctcatctcctactaaactctgcctactcgtataaatggcagctcagattcctgaattaacaattcacactgacaatttaataactcgttatacacacacacacctatcctgccaagctggactgtctactctgaaacaagggacagcagatgtaagcacagaaatagttccagttataaacaattaaaagatacatatcatgtatatttaaaaatgttctcggccgggcgcggtggctcacgcctgtaatcccagcactttggggggccaaggtggatggatcacaaggtcaggagatcgagaccatcctggctaatacggtgaaaccccgtctctactaaaaatacaaaaaaattagccgggactggtggcgggcgcctgtagtcccagctactcgggaggctgaggcaggagaatggcgtgaacccgggaggtggagcttgcagtgagccgagatggctcacagatcaagactccatctcaaaaaaaaaaaaaaaaaaagttctcagctactgaaatagaaactaccaagtaagaaacaggatatcacagagaaggcaagtttgaattcagggttctaataggctttatggaatactacacgttagtatgaacacggataaatggattaaaaactcaacacgtataaagttttaattaaatttttatttgaccaagaaaaaactgtctagaattgcctgacatttaaaatccacttaaagcagattagcaacttcaagcatcacaattattcagcataaagagcctttgttgaaacatctttctcatttatttagaagaaaacatctagaacagaaccaagcaaaacttttgtatttttgtaaaaaatctcaattcctgaaactactataaacaatctactgaaactgtattcagcaagggacagatttacctcaaggccatgttcacctgcaacctgctgataagtctgttaaaaaacaaagcaaaaaaaagagtttttaaaaattagaccactgtagccacaatccctaacactggacagttaaaacaaaagttatcaaaatctgttcttttcttagctttacctgtatcactttataactcctgagaaagtcattcacataagctgtggcctccccaccttaacaaaggggaaaaagaatatgtaaaaccaccacagaatcttggcgtaaactaacatgggtttagtaatacagagtacagtattcaggatttaaggcacccttacaagtcagaattggaaagttggtttgagacttgcaatctaaaatgacactgatttctgataaaattaaatgacttttatttagaaaagtgtgtttaataaattacttcctgctggttcaaatgacacacaatcactttgtatacatccaataagatatttctgaagtgtatacttggtcaaaagtaaaaagcagagcaaatgcatggacagtggggccttcttcttaatacttctcatcctccaaaatctgttaaaatcatcatcttccacaactcacacactggaagctgtccacagcacaattcactgtgatgtggcattctgtaaataagactacattggtcttgatgcaaggcggttcagctaccagactgcactataagaaaagtcctctcctcaacttaccaagaaaacttcgccaatttctagtcaccttcctatcaattagtagagcaagattctcacatgttcactatgtctttctccagttttctcatctataagtgtactactcctattttctataggaagacaatggaaagcgtgtaattgctgttggtagataagtaggtcttgaatttattttgcaaacaagacctgttctatctaccttttcatttaggaggctaaaagcagagtcagcttgatttcaaggactctattttcttagtctccagaagaacataaccaaatccagcttttaaaacactgtcctttaacaagtcaagatactcaaataaagatcatgtataacttcaagctataggagattaactctgtacatatgcttgtttcactgtaaccaatggttaattaatctaaatgcaagagaaaagttatttggaaagaagaccccagctggtcagcatcttttctgtcatcaggaagtctcctggaaggagtatgactatgacctgggcacaacaactgcccctaagttagtacttattttagagttgctactgaacaggtggtggttcttgtcaagtatatcatgtctgactactttactgcttgttttctgctatcaccagttccagaaaaaaaaaaaaaaaaaattaagcccaactcactaattgattgctttttcattttcccagactgtgacagaatcatggtttttagctctattttcaccttactcaaatcctggaggaattaaactatcatttatttgaaatgttacaaattagcctgcagttgattcaaacaacatgtagtcactcagacatagcaaataaaaatgttttggtatatgaa

SEQ ID NO: 7786 - DNA, 2356 bp, Homo sapiens
  ENST00000541889
ggaaggaaagcctgctgaacacagattcaattttctagcagaactccaggtcctctgagttaaaggaagcatttatggacgcttagcagggcccagatattcactattaagtgtccaggaaggatctttcttatataaaggtgcttctgaggacttccagagttacaatggaggaggaatcgggggaggaactggggctggacaggtctactcccaaggatttccacttttaccacatggacctgtatgactctgaagacagactgcacctctttccagaagagaacactaggatgaggaaagtagtccaagctgaaatggccaatgagtcaagaggagcaggggatggtaaggctcaaagagaccttcaagaggaagtggatgaacttgtccacttatatggacttgaagatgatcatgaattaggggatgagtttgttgatgaaaacatacccagaacaggggtttcagaatatcctccttatatgatgaagaggagagacccagccagggagcagagagactggagacttagtggagaggcagcggaggccgaggacctgggcttcggagggtggggctcagcaggccagtgccaggacttgcgggaagcctataggtacacacacggccgtgccagcgaggagtatgaatgctatgtcatccccgaggaagaggatgaagaagaagctgctgatgtcttctgtgtcacttgtaagactccaataagagcttttcagaaggtttttgatgaacataaggagcatgaagtgatcccactcaatgaagcactggaaagtgccaaggatgaaattcacaaaaacatgtacaaattggaaaagcagataattgagatggaaaactttgcaaatcatttggaggaggttttcatcactgtggaggagaattttggaaaacaagaacaaaactttgagtcacattacaacgagatcttggaaacacttgctcaaaaatatgaggaaaaaatacaagctctaggggagaaaaagaaagagaagctggaagccttatatggacaactggtcagctgtggagaaaacctagatacttgcaaagaactgatggaaacaatagaggagatgtgtcacgaggagaaggtggatttcataaaggatgcagtggctatggctgacagactcgggaaattcctgaaaacaaaaacagacgtggaaatctctgcacagcctgagtttgaagaccagaccttggatttctctgatgtggagcagctgatgggctccattaacaccattccagctccttctgctccagtcataaatccacaggtccctaactcagccacaggttcctcagtccgagtgtgctggagcttatactccgacgacactgtggagagctatcagctgtcctaccggccagtgcaggacagctcacctgggacggaccaagcagcaccttctccccccattattaaaaccaaagagataaggagctgtgaagaggctgtgctgatttgctgggagtctgggaacctgaatcctgtggactcgtacactgtggagctgacccaggctgaaagtccagaagcctcgggtgtaactgagtctgttgtgggcatcccgacctgcgagtccgtggtgcagctgcagccggggcggagctacattatctatgtgcgagccctcaatatggggggccccagcgtgaggagcgagccagctacagtccacaccataggaagctactttcgcctaaacaaggacacttgccatccctggctgaccatttctgaagacggacttacggctgtacgaagtgaaaggagaacccccgccagggagctgtcacccagcgacactcacttcaccaggtgtgttgctgtcatgggaaatctaattccagtccgagggcaccattactgggaggtggaggtggatgagcatttggactacagagttggtgtggcctttgcagatgtccgtaaacaggaggatctgggagcaaattgcctctcctggtgcatgaggcacacatttgcatcatcaaggcataagtatgaatttctgcacaacagaacaactccagatataagaataacagttccaccaaagaagattggcattctattagactatgaacattcaaagttgtcatttttcaatgtggacctttctcagcatctatatacatttagttgtcagcttcacgaatttgtgcatccctgtttttctttggaaaagcctgggtgtctaaaggtacataatggcatttcaatgccaaaacatgtcactttctattagaacattctgatgtccagtttcctgtcttccatgcctacccctctcgcagctgctcacgccttagctggctgaac

SEQ ID NO: 7787 - DNA, 603 bp, Homo sapiens
  ENST00000561368
catgcagaggtcactaggaaggaaagcctgctgaacacagattcaattttctagcagaactccaggtcctctgagttaaaggaagcatttatggacgcttagcagccactggggaccagctctggccaggacaattccgtttgccatgatgtgggttgaaatcacaacttctcccgggcgcagtggctcacgcctctaatcccagcactttgggaggccaagggcccagatattcactattaagtgtccaggaaggatctttcttatataaaggtgcttctgaggacttccagagttacaatggaggaggaatcgggggaggaactggggctggacaggtctactcccaaggatttccacttttaccacatggacctgtatgactctgaagacagactgcacctctttccagaagagaacactaggatgaggaaagtagtccaagctgaaatggccaatgagtcaagaggagcaggggatggtaaggctcaaagagaccttcaagaggaagtggatgaacttgtccacttatatggacttgaagatgatcatgaattaggggatgagtttgttgatgaaaacatacccagaacaggggtttca

SEQ ID NO: 7788 - DNA, 20788 bp, Homo sapiens
  ENST00000424728
atggagctgtacctcggcgcctgctccaagcctgccaaagtcgccgtcaccaagacggtcgccagcgtcctggccgcggacacccagcagtgcagagacggcgtgcacaaaacccactttgcaggggttggaccggctcagctactggacctacctctcggggtcaagctgcctgtgatcccaggaagcaatgctgtattctatactacgaatttcggtgaaaagctttttcgaccttcttatggttttaacctgactgatccctattgtcgacttttggaaaaccaatataaaagcctccatgatccacatttaaaagcatactataagcgcaaagatattttgaagagattaaagaaaggtggctacatcaccagcaataataaagttgtatgtaccttgagagaattgaataagtacaggcaatatcttaccagtttaaaattagactttgagagaaactatataaaagaacaaagaatacttgcaaaacaactacataacataccggaaaacaatcaaatccctcaacattgtgatgttgcacaagtccaaaactggttgttaaaggagggcactgaatctattaaggaccaggagcggctgatgaggcatagatatttggatatgataagtagaaaactagaacaacttgaacgcacagcagaagaacaacgcctattcctaatggatagagaagaaagacgacagcgggaacacacaagaagaaaacttactcttcgtagaaaaatagaagaggaatggaagacaaaagagatgttacttctgacaaggatggcagaagatgttaaaagagaagagaggatagaagaacaacagcatagaaacagagaagagagtgacaggaagaaacaagatcttctagagaaaaaaatggcttatcatttacaaaaaatgcaagatactggctttaacggagaagatataggaaaaaatacatttaaatacagaggtcaagatggaacacatgcttctccaaagaataaaaagaagacttctgaagatataatgttagtttatcctgctggagaccagaatacatataaagaaacacatggacatacagcaaatgctgctcatcagcgtcaaaatagttcaaataattttacgaaaaaaaactcagcttctgttgtttatcaggcagatgtacaggataatggtataaatcaaaagagagatgggatggtatctaaaaactcaagtattttcgatgatagaggaggtataaatatttcaggccaaggttcaattatttcagcgcaggtatcacccacgagaaatttttccagagtttcacaggcatttttggatccttcaaaagaagagaaggagacaaatgctgattgggatggaagaccaaccaagagatcaagctatctctgcgaatcaggacctcaggctcatgctacagacccgggtatattttcttctcctgtttacacaaatatgcaacagaacttgctgcaaaattgcttgcaagaaaaagtaacttctgaagaactgaatattataattcagaatgtaatgacctgggttgtggctacagtgaccagtatattgtacccagccatcacaaagtatgaaaaaagattgcaaaataatacatacccagtatctgatgactccatcctctcttcagatagttcaagtttctgtagcacgtgcagtgaagactttacatatagaagctacacatctgcaacaactaaaacatttcaggcagaaccctgtgcatttgtagttgacacgtcagtaaggagaccaaccacacctataaaacctcctcctgcacatgtggaaaaaacagttgtggggaaaacatgtcacataaaaggacaatctataatctctaaacataaatataataaaaccaacttgctatattcataccctaagctcagaagttgtaaatcagatagtcaccttttagcatcatttgaaacaggcacaaaaaaatctaaggatgctaccactgaaacagatagcttagggagttcattgcattgtgataaaacagcaaaagccatggatgaaatgaagaatttaaaaaatgtttttgttaactttaaatgttacttgaaaggggaaactgaagtgattttagaaagcattttgcgagaaataatgtctgatttaacccaggccattccctctctctcttctgttactgctgaagtttttgttgaacaatgtgaacgtgaaaaagaaatcttgctttccaatgctcatattccctcagttgcttctgagattgtggaaaatatgcttgagaagttagagtctgcagttgagaaaaaatgtgttgagatgttttcacaagatttgtcagtcgacattaaaccaagtttagcagccagtgatgaacttctcacatcatctaatggaaaacctttgaaaaattcaatgcctcatactttggacccaatgtgtgatattgcagaggacatggtgcatgccattttagaaaagctaatgactcttgtttcttttaagcaaaatgaatttcttcatcttaaagacacaaataagctttcctgccagcaacataagacagacccaatatgtatgttccttcaaagagctggcaaaaataaatctagtcttgaatctgatgaagctagtttaattgtcaatgaagaagtacaaaatttaatatcaaatattttttcccagtcttctttggttgcttatatagaggaagcaatcaatgctatactaggttatatacaaactgaactaaataatgagagaattattgcatctgaagaaaccgtagtactccttcagctacttgaggacatcctttttcagctccatcaggaaccagtaaatgaaagttttcaaaaaagtaggcaacctagaataagtagtccttctgacaccaaagaaaagtacagactcactggcactagattatcaaatagtcctaggtctggaagaccatttccacctataaatgttccaggcatggttctttattctgatgatgaaaatgaggaaatagacaatattgtaaaaaatgtgcttgattcaactttcaaagatgaaaaagtaaaatcacaagaacagattcctaatcattggtttacaaagggaaacacttgttttgaatgcaaaagaaatatcaaaccacctacaaagcctggttctagaagcaaagctgcatttcatgattgggaattaaagactgagccaccatctactaatcatgaagatattttaaagaaaaaactttcttcgaataaagacatttcaactttcagccaagatcaaaagcatcaaatagaaaaggcttcagaaaacatagtcacaagtattttaaaggaaatgctcaaggacatatcttccgttccttttggtcacttagacagcaaaactggcagtgaagcttcagttcttgtttcagaaaagcctcaaggactgtcacatcaagaatggatagaccagatgttttctgtttcagaaatcagtacagtggctcaagaaataacagattctgtgttaaacatacttcataaggcatcaaactacatttccaataccactaaaagttccatttcatcatcagttcatcagatttccttacataattctgacactgaacacatagtcaaagaagcaccaaataaatacccattaaaaacatggtttgacagtgaaaagaaaatgaaatatttatctttatttgacgttgatcctgaaaagcctccctggttaaaatctggaaaaagtgaacctaaacctgtagatgacattaatgataagatcattcgtacaatttttaaaagactgaagtcatttatttgtccaaaattgcatatgggcttcaaatcttcattacgatctcaacttagtaagtacacagctaaaatagtaaacattgttttatgtgctatccagaatgaactggaacttcacaaggaaaacctaaatcttagggagattgaccataccaaatcccttacagataaaggattttttgctaatactgataaaaaattagaatctcttgtcacgagtattgatgatgacattttggcgagtccattattaacctgtatttatgatatgttgttatcaagtgaaaatgcacatcaaagaagcatttcactctcttctcgtaagccaaagtctgcaactgacagtgttgatgtacaaagcattttgccaaataggcaagataaaaaatcttttcacaaatatttggctactccttgtactcaccacagtgtcaatggtggaaaccatattaaagagaatgcaaaattgcaagtgttagaaagaattggggaaacactacatgaaatgttaagcaagctcctggggacccatcttcattctcagctatcttgtagtcaacaaagcagagagatgaccaataagaatcagaaaatggctgctgcattgcagtctaatattcagttaatttctaaagcaattttggattatatccttgcaaaattatgtggtgttgacatggataccagttttgcaagttgtggattaaaagctatctcagagtctcttgacattgacaacccatcatttgcttcaattattgagaaaatggccaaatccaccaaaataatctccagcatagtttccagaagggttcaggaggacaataaagaagagactaaaagcaaggcaaaacctgttgctcctgtgtcttccaaaacaccaagcacaaaagaaatgcatccaaataaactaaaagctgtagcttcagatattcttaatatggtttttgctaaactggaagggtttgccaacggacatttagaaattttgggtgctattaatgatggaaataagaaaagcaataagataggctgggaatatgaaagcaccaatatttccagagacacacatgaagcatcatttctgtctgctttatatatgcatgcaaagaaggtatcaagtgctattttgaaggttattcaaacagaattaaatgtgacctcatcagatttgaagacaagtgtagaaaacccaccacctgagactcaaatacttaagtatgtagtcaagttaattttagatgcagtatcttccgatatgtttaatgaaatggaatctgaagggggaggcattgaaacttatcgatacaggccaacatatggaagtcttcctggaggagctgaatcagattcatttctagaagatgatgcatatacagcgaaaaaaattattgatgagagatccccacaaagagaagaagtgaaaacacgttctcttaaacaatgggctctcgaaaaaaccttaaacaaaattgaagtaaaactcaaagaaccacatatatctccaattgctcccattataagaaatattttgaatgaaatttttcaaagtactttaatcaatcaattaaatgtcctttctctctcccactctaattttaatggcatgcctcacaatgttgatgagccaactccccaaacatctgttcaatttatggataaaatgatggatcctttactttcggaagcagatataaccatagtaacagataatattgttaggactgtatttcacaaactttattcagctgccatgacagaaagaaatgtaagggaaaataggtataaaactatcactttttcagcaaatgtttcttctcatgaacacacctataaaggaaagtcctctgtcacggctttggatgaaaatccatgtacttttcagtctagattcagcgttgctgacaaggagacaaaggtaaatctagctgaagatattgtacaggcaatattaacaaatttagaaacttttgctacttccaaagtaaaatctctcttttattctcaagtcaactttacagttccagtggctttacctattcagcaagatcacagtacattgagcaaagcattatcagccaaagattcatattctgatgagcaattttcctgttgctcagtagatcataccaagtcaggaaagaccaacttgtgccaactgtctttgtctaaattaaatacttatgcactacaagtggctagaagaaatttacaaggaatcaaacaggaattagataaagaaagggaaaatccttttttaactcatgacattgggatttctgaaagtattgcaagtcaaattgttaacgcattgttagacattatatcacgtaaaggcaaatgtgacaaaaacagttctgacaaagagatcgatttagatcagcaaaaaggtgttattgaaaagctgctcaatgagaccaaatatcgaaaagtacttcaacttcaaatacaagataccattgaaggtatcctatgtgatatttatgaaaaaaccctgtttcagaataatctctcatttgccacacccactctgaaatgtagcatagctgataaacattcagaagaaaattctgaaatgttcatggagggtgcaaataagattattcctaagctttcagttcctaaatcagatgtcattttgatatccaatgatatagtgaatattgttcttcataatctcagttctgctgccacgcttgtcataaatgcaaagaatcctacttctgcaagattgcccctgacattttgtgatacgtttccaaaaatagactgtcaacagcctcttaaggggtcaaaaactgaaagaaaaacagagcgtttttcatattcaagaaatcagaaatcagcttatgctgatgataatcagataactgtagtagagaaagaagacactcagaaatctgctactgactcatgtgaggaaaatgctaacttcattactaaaactatttttaaacgtttggaatcttttgccacagaaagaatagattcattaattacccttgctttccaaagtaaagaaaagtcatttgttatcccagaattggaaaattgtaaacaaaatgacagcatcttttatgattcaagccaagtggaatcagatgtaaatgtcctgaaaatatcagcaactgaaaccattctcagccaagagcttacagatttcacttttgttggtcgcagagaaaaacttggatccacaattcacctatcgcaagctaggcttaagacatatgctgacgtcattgccagtgccattttgaagcttattaaaaatgacttagacttagaaattcaaaagatatatccatatcaaaacaatattttgttccaagaaaacatcattgtgagtgaaattgttgacagtatgttaaagatgttagatgataaaagatctgtaaaggaaatttgttttaattcaaaagaaaattctaacttttcacaattagctttatcaaatgaaatattgctgggtcacaaagagaaggaaagaagtaccaaacaatctctatttacaaagtatccattagagcaaaaccaaatgatattggaaaacaaaaggcagataattgttttggaagaaatatttatgagaaatggagaatcaaaaaacaaagaaaaaggtgaactgctcattgcagtggaagaacttttgaataagttgtatcaaagagtaagggaagtcacaggccatttgcctccacttaatgaaactgccaactttatatctaattctaagattaaaacatcagacacaacacagaaaaacagttttcaatcacatattaacagtgtagcaaatgacatagttgaaagtgttttggggaaaatgtacttggtagttgtgacatcattatatgaaaataataaaagtaggacagaagttgaaatatctgaccacaatgattccttactaatgaaaccattaaggtttagagaaactaaacaagcaggaaaaataagtaattcccctagatatgcgatatcacaggcttattcttatgtcgacagtcaaaatatctctgtgatggaaaacactcttttgccatatttaccattgcaagtgaagaaagacttaattcaaatggttctcaataagatcacaaattttgtctcacttcctttaaaggtgagccctaaggacaaccctaagccatgctttaaagcacatttaaaaacaagatcaaaaattaccactttgcctaaatttacaaaaaaaacacacttaggactgagtgctgctaaggccaaaagcaaaaccaagttaggtcctggagagaagaccctaaaagacagcagatccaagactgccattgggttgtcacacatcatgtcagctggagatgccaaaaatttactggacacaaaattgcccacttcagaactaaaaatatatgccaaggatataataattaacatcctagaaacaattgtgaaggaatttggaaaggtaaagcaaaccaaagctttaccatctgatcaaatcatagcagcaggtaaaatagttaatacagttttgcaagaattatatgttaccaataactgcaatttggcttacccgatgaaatcctcacatctcagactttcacaggggaatataggcacaggatcccttcctaaacaacaagcatgtttttacttggagaatgtttcttcacagctagagcacatttttcctagagaaggtatatttaaaaaattgtttgacaagtggcaaacagaatcaaatgacaaggaaaatgaaaaatgtaagctattgatgatagctgaaaatgttttgactgaaatttcaataaaagcaaaagaattagaatattctctttcacttttaaatttgccccctcttgagaattgtgaaagcaggttttataatcattttaaaggagcttctactagagccgaggatactaaagcacaaattaatatgtttggaagggaaattgttgaaatgctacttgaaaaactacagctatgctttctgtcccaaattcccactccagatagtgaagaaactctatcaaacagtaaagaacacattactgctaaaagtaaatatggttttccaaacaagcatagcctcagcagtttaccaatctataacacaaagacaaaagaccaaatttctgtgggctccagcaaccaaattgttcaagagattgtagaaacggttttaaacatgttagagtcatttgtggacttgcagtttaaacatatctccaaatatgagttttctgaaattgtgaaaatgcctatagaaaacctttcttctatccaacagaaactgttaaacaaaaaaatgttgccaaaattacaaccactgaaaatgttttctgataaatccgagtcaaatactattaatttcaaggaaaacatacagaatatccttctacgggttcattcattccattcacaattacttacatatgctgttaatatcatcagtgacatgcttgctgtaattaagaacaagctagacaacgaaataagccaaatggaaccatcttcaattagcatattgaaagagaacattgtagcaagtgagatcattggcacactaatggaccagtgtacttatttcaatgagtctttgatacaaaacctttcaagagaaagtttgttccaaggagctgaaaatgcctacactgttaatcaggttgaattagcaactaatatgaaaatgttcacatcaaagttaaaggaaggtagtttggggattaatccttcacaagtgagtaaaactgggtttgtgttttgttcagatgaagatatgaaagaaaagtacagggtttcatcagatttacccacctctgtcagatcctctgtagaagacacagttaaaaactcagagccaacgaaaaggcctgattcagaaactatgccatcgtgttctactagaaacaaagtacaagaccacagaccaagggaatctaactttggtagttttgatcagaccatgaaaggaaatagctacctccctgaaggcagtttcttacaaaagctgcttaggaaagcaagtgactccacagaagcagcattaaagcaagtcttgtcattcatagaaatgggaaaaggtgaaaatctaagagtgtttcattatgagaacctaaaaccagttgttgaaccaaaccaaattcagacaaccatttcccctctcaaaatatgtttagctgcagaaaatattgtcaatactgtgctatccagctgtggctttccaagtcaaccacacactaatgagaacagggaaataatgaaaccatttttcatatcaaaacaaagctctttatctgaagtatctggagggcaaaaggataacgaaaaaagtttgcttagaatgcaggataaaaaaatcaactatatacctgaggaagaaaatgaaaaccttgaagccagccgggaagattcttcttttttgcaaaaattgaaaaaaaaggagtacccaaagatagagactgtgaaggaagttgaagcctttacttttgctgatcatgaaatgggttccaatgaagttcatctgatagcaagacatgtcaccacatctgtggtcacatatttgaagaactttgaaactacagtttttagtgaggaaaagatgtctgtttctacatggtcaaggaaaaaatatgaatcaaaacagttcctaagaaacatatacgatgattcttcaatttatcaatgttgtgaacatctcactgagtcagtactttaccatttaacttcgagcatttctgatggcaccaaaaagggtagagaaaaagagaaagcatgggaaattcaagaagcaacatttagcaagattatttcaattcattctcaagtgtttgagagcaggtcaatttccattggagaacttgctttatgtatttctgaaatcattattaaaattctttttaataataaaattatacaggctgacattgcacagaaaatggttgccatacctacaaaatacacttactgtccaggaatagtttctggtggctttgatgacctctttcaggatctcttagtaggagtgattcatgtactgtccaaagaaatagaagtagattatcactttgaaagcaatgtaagaaacaaatcattttctatgcatagaaataatagtgtacccctttgcaacaaaatcaatagacaggcaagccccagagactggcaattttctactcaacaaattggtcaactttttcaaaaaaataagttaagttatcttgcatgtaagttaaacagcctggttggtaacctaaaaacaagtgaatccaaagaagtagtcaataaagtttttaatattgtttcagatttattttcaccagatgaatgcctagatacgggtatggattctggtaaaatacaaagaacatatttctactcctcgaataatgagcaacctaatagcatacttaccaataacctacagctctcctcaaaatcagtttttcttctcaatgttgtatgtgagaaacttatcagaatacttttggaagaatgcacaagcactgcttttcctgataaagggtctgtttcagaggaaacatcagcagaagaatgtcaacttttaaaaatgcttcaaagtgtagaagatggaaaatctgattatcgtaagggaggaatggactgtgaatgccttcaagtagattacatgtcagaccttttggagaatgtggcagaaattgatcaagacttattgacatcagactctatgcttactattatttcccacagcttggttaaatcattgatggacaaattatctcacagcatacaacaagctccggaaagtctaccttttgcaaataagcatttgaactacagaacaagagaaatacagtctagtttcataaaagcaagaaagtcagaattaatagaattaggacagagtaaaagttctttagaactcaggagctatgatagtaattctttgacagtatccctgaataatcccagtgtggttagctccaaaatacaagcaccatttaacaagcattgtgcagtaaaatcctcttctgtgtcaccttttgaaagacagagaacaaaggaaatggataaggtagccattcataataagctacatcaggaaggtatatatgctggtgtttattcagccacatttttggaaggaataatttcagaattgttttttaatctctctatgtcattgtggggcaaaaataaaaacatcactgtgtcctggctcaatgagatgaatacattatttgtcaacaatgtagtgaatgaatttaataatgctcaagtcactgttctacggaatgctgaagaaaggctgtgttttccaccagttcatacagaaactgttagcaaaattgttgactcagtttattatgatgttttacagcagtatgaattaaaagtggcctgtggtaataatccggtatacgacaatgcctcaatagcagaacaaataacaaatggcatattgttagagattttagactacaaactgccatcttgcttcaaggaacatctcataccccattcatattaccctctcaaacctgaaattatattgcaaaagcttcaaagtaacctaacagaatttacttctctacccaggtcttcatcagactatagtaccatgttatcacattcatttttagaagatgtcataagaaggcttttatctcagctaattcctccacccattacatgttcctctttaggaaaaaaatatttaatgagttctgattttaatgaaatgtccacttgtataataaataaggttatgtcagccatttcaaaacataaaatctggttcactatatatgataatcaatatctatatactggaaaaaacctccaaaagatggtggattctgtatattgtaatattttgcaaatgtctgactctcttgtttcaatacaaaaaagtatagtaagccgaagcccaattatgattgaccaaatagccagctttatcatccaagagattatcgaaaatcatcttcaaccatttttgagtggagaggttttatgtcatccaaggactccactggatccagtgtctactattgttacacaggttctgagtgaagtgatagagtcacacagacctcagaagcaatcacctttagatattcaccttgattcatttgtaagggagattgttgccagacttttgtcaaagattttcagcccaaagcataacactgaaattgagttgaaaaacatgacccaaagaatagtaaactccataaataggcatttcaataaagctaaaattcacattctctatgatgacaaagaacaggctttcttttctttcaatacagatattgtggatgaacttgccacctcagtttatagaaatgctttaaagcagcatgggctagaccttgctgttgataaagagtctgaagacagtggcatttttgtggaaaatattaccaatttaattgtagcagctatttcagattaccttcttcatccactgttttctggggatttttcagcttctacctattctaattcagtggctgagaatattgttcaggacatccttagtaacatcagtaaatctactgagccaagccagagtgtacctctatataacaccttgctgccatacacatttttagaagatatgatcagagtactattatctaaattattttcttctgcatctagcctggttctaaacagagacacccaaaaagatatatcaagagtgaatttcaatgacattgcttcaaacctagttagtgatattaggatgaaagtttcccaacatgaaattcgattttcaaaagaggaagaagaaaccaagtttatttattcagaagatgatattcagcaccttgttgattcagtatttgcaaatgttgtgcaaacctctggttctcaagaatcagctgtgcaaaatatcacaagcagtaatgacattcttatagatagaatagcaggtttcatcattaaacatatctgtcaaaaacatcttcagccatttgtgagtggaaaatcattatcttcatcagacacatattttgatgatgagagaaggcagttattttataccagtgtttactcttcaacattcttggaagatgtaatctctggggttttaagaaaaatattccacagggtagtaggcattgtacaaacaaaatccataagagattcagaagatgaactgtttgagaaagctgaagaactcatacatttgattacaggggaattctcaaaagcccaagttagcattatagataatactgaggaaagactgtgtttacctccagtggagagggatgtagtcaaaacaattgttgacatggtgtacagcaaagttttgcaagaatatgaaatggaagtcgtgcccaataaagattttctaaatgacacaaagacattggctgcaagaataactaatatcatcctggctgaaatttttgatttccaaattcatccagatcttatagcaaatctgccttttaaatcacattccaaactcagtgcaaatgttttaatacaaagagttcaatatgatataagtaaatcaagattccaaagacaagcttcaacaatgtataccactatgttatcacatagtcatttggaaaaaatagttactcagcttacatctcagataagtccattgaacaccagtgcagagcagtcagatactactaaatcagacttaagtaatacagtgataaaactgataaatgaaattatgtcaataatttcaaaacatgaaatatgtattattaaatatgggaataaaaaacagagtatgatttcagcaaaagatatccagtctatggttgattccatttatgctgatctttctcattcaaatatataccagtccattacaaaagataaaaagagcataagtgacatacctgtttcaaaaatagcgagttttataataaaagaaatctttaaccatcatattcaatcatttttatctgaagataaaactctccttttggcagcagttgatcaaacttataaattgaaagcaatagatcctaaacaaagagaattatcttttattgtgaactcatctgtctttttggaggaagtaatttctgagctcttatgcaaaattctttatgcattttcacataacatgttggttactgaaaatccagatagagtgaaactgaaacttaccaggattgttacaacattggtaaattcaattgttctggagttcaccacatcagagattttagttgcagataactttgataaaaatttgtgtttctcagaaagatacaaagaaatggttcaaaaaatagtcaactcagtatatggaaaagtattagatcaatataaatctctgattcaaatacatagggttatacaaagtgacacaatatgttttggtaggaaaatatattatttgctattggaagaaatatatgattatcaagtgcagtcattagtttcaggagaattagagtcttcttcttattcgtatccccaagctgataatatcatcagaaatgtgcttaacataatcacaaaggatagccatgccttgccaccatatattactgtgttgcctcattctcttttagaagatatggtttacaggcttctagggcatgtcttcccttcaactcacactgaaaatgaactaaaagagaaaaagtttccaccggatgatgaatttgtggaggcagcttcaaaattgactgatgaaattataaaagaaatttctgaacatgagattcgactttccatggcagaggataatgcagaaagtatgcagttagaacctattgaaaatttggtcgactccatatgtaataatattttgaaaacatctgaattccaagctgaagtacaaaaagatgcagacaaaaaaggatgctcattcctcagtaaattagctggttttattatgaaagaaatcatgtatcatcatttacagccatttttacatggtgaagaatcatctttcagtgacttatctgattatgaccatgtctctgaacttgctaaatctggtaaagaaaagacacagccttctctctattcagctacatttttggaagacataatcattgaccttgttcacaaattttgttctctcctcattattactgaagattctaagaaaaatgaaatggcagagctagatattatgggcttggctctaaaacttgcaaattctctgataagggaatttaagaaaagtgatattaaagttttaccaaatgctgaaaaaatgttttcttttccaccaattgataaagagacagttgataaaatatccaattttgtatatgaacagttcatagaaaaatgcacatctcatgatattcaaaaaggtgatgaaagtaacattgctatagggatgattgctgctctaacccagaaggcaatatctgcattcaggattcaaccacttttttcaggagactggtcttccaccttcttttcatttctaaatccagataatatcacccaaagggttcaacacctaccacaaaacacctttacacaaataagcagatgtgcaaaagagaaccaactttctttaccagatcaatcatataaagatacttcttccaccccagattgcaaaaacatgatgagcactttggaaataaatagaggtacaatgaatagaaagaaaagttttaaaaccaaggacacatcagtgaaaaaaggtgacatccaaaatccagtacttagctctataaatgcaattatgaaaagcggcatgattaacctaacatcagggttggctacaggtgtgacaaataaaaaggaagtggatgaaaataaagtgggaatttgtactcaaaaacatagtgagaatgtatcaaaagttacttcaactaccactgtgaaaagtaaagatactcaggagccaaatttgagtgaaacatttaataataatgaaattgagaagaaaagaaatttaattccaacagataaaaaagggaaagatgatgagatatacacacatttttcattaataattgatgatacagaatatgagaaggaagtacttggatcagattctgaaataggctataaaaagaagattgacaatgcaagggaaagctcatttaaaaaagatgacaagctctttcagttatcctccttgaagtccaagagaaatctagggactacaacagatactttggaaataagaattcgaacatcaagcaatgaggggagaagagactctccaacacaaacgtgtagggatgaggaacaccactcagattatgaacatgttcaaaatgtcattgaaaatatttttgaagatgttttagaactatcttcttctccagaaccagcatattattcgaaactcagttatgaccaaagccccccaggtgataatgtattaaatgtaattcaagagattagcagggattcggcacagtctgttacaacaaaaaaagtatcctcctcaactaacaaaaatatctctgccaaagaaaaagaagaggaagagagagaaaaagagaaagtaagagaggagattaaaagtgaacccagtaaaccagatgatcctcaaaaccaacgagaaagtaaacctggaatttttcccgctaagtttttagaagatgttattactgagatggttaaacaattgatcttttcttctataccagaaacacaaatacaagatagatgtcaaaatgttagtgataagcaaaatcaagccaaactctatgacactgctatgaaactcatcaattcactgttaaaggagttctcagatgctcaaattaaggttttcaggccagataagggaaatcagttccctgggggtaaagtgtcttcagttcctaaagtacctccaaggtataaagagccaactacagatgaagcaccatccagcattaagataaaatctgcagataaaatgccacctatgcataaaatgatgagaaaaccttcttcagataagataccatcaattgacaaaacattggtcaataaagttgttcactcctctgtttgtaatattttaaatgactatggatctcaagactctatttggaagaatataaacagtaatggagaaaatttagcaagaagactaactagtgcagtgataaatgaaattttccaacgtcaggttaacttgatattttgtgatgaggtttcagtttcagcatgtttgcctctggaatctaaggatgttgttaaaaaggtccaaaagttggcccaaacagccagcaaagaatgtcaaacttcatcaccatatacaataatattacctcataaatttttggagaatgtgatttctgctcttttctccaaaattttctcaacaatatccagcacaaaaacaaaagaacctgaggacaatttgtccacagaactgaatttccttcaaatgaagttagtaagtgcagttgcaacagagatctcccaagataaatatatgactatacagtatgtagaaaccttacaatctgatgatgatgaaattattcaattagtggttcagtctgtttataataatctcttgccacagtttggatcacaagagattatacaaaattgtgtaaccagtggatgcaaaatcctttcagaaaacatagttgacttggttctacgagaagtggctagcaatcagctgcagagctatttttgtggagagctaactccacatcagtgtgtggaagttgaaaacatcgttgaaaagatccttaaagatgttttccaaactactgatgtgcccctacctaaaccttcacatgctgataagctgtcttataacataatagaagaaattgctgtgaaatttttatcaaagcttttatctatatttccaaaagtacataaagaaagaacaaaatctctagagactgatatgcaaaaaataacttcaaaagtactaaattcagtccaagaatttatctccaaaagtaagattaaacttgtaccacccaccaaggaatcacctactgtgcctgtagctgataatgcaactattgaaaacatagttaattctatttataccagtgttttaaagcactctggctcttatacttctgtatttaaagatttaatgggtaaaagcaatgtcctctctgatacaataggctttttaatggtgaatgcaatttcgaattctgaatttcaacctcaagtagaggaagaagtatcaaattcagaattagttctggaagctgtcaaaattatggaaaaagtgatcaaaattattgatgaacttaagtctaaggaaaagtcttcatccagaaaaggtttgacattagatgccaaacttttagaagaggtgttggccttgttcttggctaaactaataaggttgccaagttcctcaagcaaagatgaaaaaaacttatcaaagactgagttaaataaaattgcatctcaactgtcaaaattggtaacagctgaaatttccagaagtagcattagtctaatagcttctgatcctgaagagcactgtttaaatccagaaaatacagaaaggatttatcaggttgtcgattccgtttatagtaacatactgcaacaatcaggaaccaacaaagaattttattatgatataaaagatacaaatacagcctttcctaaaaaagtggctagtttaattattgatggagtttcaagttttccattagatacaattaactcaacaatttcaaatgctgatctctctggagagctagacgttaatagaattgttcaaaaggcccaagaacatgcttttaatgtgattcctgaattagagcaagaaaagttagatcaaaatttatctgaagaggaatctccaattaaaatagttccacatgttggaaaaaaaccagtcaaaatagatccaaaaattatttcagaacacttagcagttatttctataaaaactcaacctcttgagaaacttaagcaggagtgtttgaaaagaactggacatagcatagcagaactgagaagagcatcaataagtgggagaaattactccttaggatcacctgatttagaaaagagaaagacagaaagacgtacctcattggataagactggaagactggatgtaaaacccctagaggccgttgctagaaattcatttcagaatataagaaagcctgatattacaaaggtggagctcttaaaagatgttcaaagtaaaaatgatcttattgttcgattagtagctcatgatattgatcaagtgtatttggaaaattacataaaagaggaacgagattctgatgaagatgaagttgttttaacacagacttttgcaaaagaagaaggcatcaaagtatttgaagatcaagtgaaagaagtcaagaagccaatacaaagcaaactttctcctaagtcaacactaagcacgagcagcctgaaaaaatttttgtcactaagtaaatgttgtcagaccacagccagtgcaaatattgaaagtactgaagcaatctcaaatcaggtaatagaatccaaggagacacatgttaaaagagctgttgctgagcttgacatggccacaccaaagacgatgcctgaaacagcctcttcatcttgggaggaaaagccccagtgtaagaaagaagaaaagaatcttgttactgaaccaacacattacttcatacacagaattatgagttcatcttcatacaaccaagaagatctcatttcatctactggtgaggctgaagattgtcactcagacccaagtgctaaaatattagaagaaagttctcaggaacaaaagccagagcatggaaacagtgttaagtttatcaccatctttgaaagatccaaggatgttcttggcagtgcaaatccctcaaaggaagtcatttcagaaactcccaagcccgatgtctccaaacaaggatctaaaatgctgacaaaaatgtcttcaactttgtcaaaggtgttttctcaatgtaacaccaatatttccagatcttcctcaccagctcaccaggatgaacactgaagcttttgtacctgatataagtatgcttacttcttttagaaaataaaatggtttttaaagcata

SEQ ID NO: 7789 - DNA, 348 bp, Homo sapiens
  ENST00000465275
tctaaactaaactaatactgcctaaaaggaaagacaaaactctccaattgtgtctgacagggcgtgcacaaaacccactttgcaggggttggaccggctcagctactggacctacctctcggggtcaagctgcctgtgatcccaggaagcaatgctgtattctatactacgaatttcggtgaaaagctttttcgaccttcttatggttttaacctgactgatccctattgtcgacttttggaaaaccaatataaaagcctccatgatccacatttaaaagcatactataagcgcaaagatattttgaagagattaaagaaaggtggctacatcaccagcaataataaa

SEQ ID NO: 7790 - DNA, 858 bp, Homo sapiens
  ENST00000469367
tttggaaaaccaatataaaagcctccatgatccacatttaaaagcatactataagcgcaaagatattttgaagagattaaagaaaggtggctacatcaccagcaataataaagttgtatgtaccttgagagaattgaataagtacaggcaatatcttaccagtttaaaattagactttgagagaaactatataaaagaacaagtaagttaaatacttaaatttggtttatttacatagagtttggaagaaatgcttgattatatgtagagtgttcttctaataatattttgatcctttattattgacaaagtaattgaatattttttccaagtgaaaatttacagtaggaataaacaatattttaattttgctatagttggccaagaatgggaaagggactgggttatctatcaacacaccagtggtagctggcataattcaataactaaattgctagtcagatgtgttgtttccccctgagctaatgccaataacaaacatctcttgtggcagaaagattcttaaattgaaacctaaaacagtttgagccataggaaaagaacaataattatctgtagtgttctacagtgattcaagaatatgtacactctgtgtttgtactcatacacgtgcacctgtaaaaatgttgttcttgaatgtgaacaaaatgttgttcttgaatgtgaagtagaatgattgggtgtagagtgaatggttatggatagtgacttccttttgatttttgacttaaaggtgtgtgtgtgtggggtgtgtgtgtgtgtgtgtgtttgtgtgaattcagattttagggtcaagaggtttggatcaaagtgagaaaggtatatttacatgagtgt

SEQ ID NO: 7791 - DNA, 2726 bp, Homo sapiens
  ENST00000429412
aaggaccaggagcggctgatgaggcatagatatttggatatgataagtagaaaactagaacaacttgaacgcacagcagaagaacaacgcctattcctaatggatagagaagaaagacgacagcgggaacacacaagaagaaaacttactcttcgtagaaaaatagaagaggaatggaagacaaaagagatgttacttctgacaaggatggcagaagatgttaaaagagaagagaggatagaagaacaacagcatagaaacagagaagagagtgacaggaagaaacaagatcttctagagaaaaaaatggcttatcatttacaaaaaatgcaagatactggctttaacggagaagatataggaaaaaatacatttaaatacagaggtcaagatggaacacatggtgaatgacatacagcaaatgctgctcatcagcgtcaaaatagttcaaataattttacgaaaaaaaactcagcttctgttgtttatcaggcagatgtacaggataatggtataaatcaaaagagagatgggatggtatctaaaaactcaagtattttcgatgatagaggaggtataaatatttcaggccaaggttcaattatttcagcgcaggtatcacccacgagaaatttttccagagtttcacaggcatttttggatccttcaaaagaagagaaggagacaaatgctgattgggatggaagaccaaccaagagatcaagctatctctgcgaatcaggtaaatatcagcagtaattattgagtaaatcttgcattctatttattctttcaactgacatttactgagtttttgcttcatgttagatatggtgctaagttttaatcattcaaggaaaaatggcacaatttttgctcagggttcttacagtatacttggaaagatagtcatggcccaatatgataagagcaataaaggaagtgggtatgtgtaaaagctgggaaagttatgggaaagagaatgcatagacctatctagggtcatcatagaagcctttataatttagaaagagactgcgttgagacatgaaggatcagaaggaatttcctattttctttttgttatttttattgtttgtactaatgttgacaaccaaaatttgcaaaaaaattaaagtttttgtactcatatccttatacttactgttttctgcttttacagcagcttctctcccacaccacaactttattaaggtatagtggataatttaaaactgtatatattgacggtacagatggtccccaacttgtaatgattcaatttagggtttttcaactttactgtcggtttattggggtattaaatgcattctcagcttacaatatttttgacttacaattggctaatcaagatgtaacaccatcataagacaaggagaatcatatacaacttgatatgtgtatatacagtaaagtgttcaccacaagcaagccaattaacatatcctcacttcatgtagttactatttgtgtgtggtggcagaagaacacttaagagctactctctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctttgttttggtaccagtaccatgctgttttggttactgtagccttgtagtatagtttgaagtcaggtagtgtgatgcctccagctttgttcttttggcttaggattgaattggtgatgcgggctcttttttggttccatatgaactttaaagtagttttttccaattctgtgaagaaagtcatcggtagcttgatggggatggcattgaatctataaattaccttgggcagtatggccattttcacgatattgattcttcctacccatgagcatggaatgttcttctatttgtttgtatcctcttttatttccttgagcagcggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacagtcatgtcgtctgcaaacagggacaatttgacttcctcttttcctaattgaataacctggatcccttccttacaccttatacaaaaatcaattcaagatggattaaagacttaaacgttagacctaaaaccataaaaaccctagaagaaaacctaggcattaccattcgggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaataaccagaatctacaatgaactcaaacaaatttacaagaaaaaaacaaacaaccccatcaaaaagtgggtgaaggacatgaacagacacttctcaaaagaagacatttatgcagcc

SEQ ID NO: 7792 - DNA, 3869 bp, Homo sapiens
  ENST00000415915
gtatcaaagagtaagggaagtcacaggccatttgcctccacttaatgaaactgccaactttatatctaattctaagattaaaacatcagacacaacacagaaaaacagttttcaatcacatattaacagtgtagcaaatgacatagttgaaagtgttttggggaaaatgtacttggtagttgtgacatcattatatgaaaataataaaagtaggacagaagttgaaatatctgaccacaatgattccttactaatgaaaccattaaggtttagagaaactaaacaagcaggaaaaataagtaattcccctagatatgcgatatcacaggcttattcttatgtcgacagtcaaaatatctctgtgatggaaaacactcttttgccatatttaccattgcaagtgaagaaagacttaattcaaatggttctcaataagatcacaaattttgtctcacttcctttaaaggtgagccctaaggacaaccctaagccatgctttaaagcacatttaaaaacaagatcaaaaattaccactttgcctaaatttacaaaaaaaacacacttaggactgagtgctgctaaggccaaaagcaaaaccaagttaggtcctggagagaagaccctaaaagacagcagatccaagactgccattgggttgtcacacatcatgtcagctggagatgccaaaaatttactggacacaaaattgcccacttcagaactaaaaatatatgccaaggatataataattaacatcctagaaacaattgtgaaggaatttggaaaggtaaagcaaaccaaagctttaccatctgatcaaatcatagcagcaggtaaaatagttaatacagttttgcaagaattatatgttaccaataactgcaatttggcttacccgatgaaatcctcacatctcagactttcacaggggaatataggcacaggatcccttcctaaacaacaagcatgtttttacttggagaatgtttcttcacagctagagcacatttttcctagagaaggtatatttaaaaaattgtttgacaagtggcaaacagaatcaaatgacaaggaaaatgaaaaatgtaagctattgatgatagctgaaaatgttttgactgaaatttcaataaaagcaaaagaattagaatattctctttcacttttaaatttgccccctcttgagaattgtgaaagcaggttttataatcattttaaaggagcttctactagagccgaggatactaaagcacaaattaatatgtttggaagggaaattgttgaaatgctacttgaaaaactacagctatgctttctgtcccaaattcccactccagatagtgaagaaactctatcaaacagtaaagaacacattactgctaaaagtaaatatggttttccaaacaagcatagcctcagcagtttaccaatctataacacaaagacaaaagaccaaatttctgtgggctccagcaaccaaattgttcaagagattgtagaaacggttttaaacatgttagagtcatttgtggacttgcagtttaaacatatctccaaatatgagttttctgaaattgtgaaaatgcctatagaaaacctttcttctatccaacagaaactgttaaacaaaaaaatgttgccaaaattacaaccactgaaaatgttttctgataaatccgagtcaaatactattaatttcaaggaaaacatacagaatatccttctacgggttcattcattccattcacaattacttacatatgctgttaatatcatcagtgacatgcttgctgtaattaagaacaagctagacaacgaaataagccaaatggaaccatcttcaattagcatattgaaagagaacattgtagcaagtgagatcattggcacactaatggaccagtgtacttatttcaatgagtctttgatacaaaacctttcaagagaaagtttgttccaaggagctgaaaatgcctacactgttaatcaggttgaattagcaactaatatgaaaatgttcacatcaaagttaaaggaaggtagtttggggattaatccttcacaagtgagtaaaactgggtttgtgttttgttcagatgaagatatgaaagaaaagtacagggtttcatcagatttacccacctctgtcagatcctctgtagaagacacagttaaaaactcagagccaacgaaaaggcctgattcagaaactatgccatcgtgttctactagaaacaaagtacaagaccacagaccaagggaatctaactttggtagttttgatcagaccatgaaaggaaatagctacctccctgaaggcagtttcttacaaaagctgcttaggaaagcaagtgactccacagaagcagcattaaagcaagtcttgtcattcatagaaatgggaaaaggtgaaaatctaagagtgtttcattatgagaacctaaaaccagttgttgaaccaaaccaaattcagacaaccatttcccctctcaaaatatgtttagctgcagaaaatattgtcaatactgtgctatccagctgtggctttccaagtcaaccacacactaatgagaacagggaaataatgaaaccatttttcatatcaaaacaaagctctttatctgaagtatctggagggcaaaaggataacgaaaaaagtttgcttagaatgcaggataaaaaaatcaactatatacctgaggaagaaaatgaaaaccttgaagccagccgggaagattcttcttttttgcaaaaattgaaaaaaaaggagtacccaaagatagagactgtgaaggaagttgaagcctttacttttgctgatcatgaaatgggttccaatgaagttcatctgatagcaagacatgtcaccacatctgtggtcacatatttgaagaactttgaaactacaggccgttgctagaaattcatttcagaatataagaaagcctgatattacaaaggtggagctcttaaaagatgttcaaagtaaaaatgatcttattgttcgattagtagctcatgatattgatcaagtgtatttggaaaattacataaaagaggaacgagattctgatgaagatgaagttgttttaacacagacttttgcaaaagaagaaggcatcaaagtatttgaagatcaagtgaaagaagtcaagaagccaatacaaagcaaactttctcctaagtcaacactaagcacgagcagcctgaaaaaatttttgtcactaagtaaatgttgtcagaccacagccagtgcaaatattgaaagtactgaagcaatctcaaatcaggtaatagaatccaaggagacacatgttaaaagagctgttgctgagcttgacatggccacaccaaagacgatgcctgaaacagcctcttcatcttgggaggaaaagccccagtgtaagaaagaagaaaagaatcttgttactgaaccaacacattacttcatacacagaattatgagttcatcttcatacaaccaagaagatctcatttcatctactggtgaggctgaagattgtcactcagacccaagtgctaaaatattagaagaaagttctcaggaacaaaagccagagcatggaaacagtgttaagtttatcaccatctttgaaagatccaaggatgttcttggcagtgcaaatccctcaaaggaagtcatttcagaaactcccaagcccgatgtctccaaacaaggatctaaaatgctgacaaaaatgtcttcaactttgtcaaaggtgttttctcaatgtaacaccaatatttccagatcttcctcaccagctcaccaggatgaacactgaagcttttgtacctgatataagtatgcttacttcttttagaaaataaaatggtttttaaagcat

SEQ ID NO: 7793 - DNA, 3882 bp, Homo sapiens
  ENST00000611759
tacagaatatgagaaggaagtacttggatcagattctgaaataggctataaaaagaagattgacaatgcaagggaaagctcatttaaaaaagatgacaagctctttcagttatcctccttgaagtccaagagaaatctagggactacaacagatactttggaaataagaattcgaacatcaagcaatgaggggagaagagactctccaacacaaacgtgtagggatgaggaacaccactcagattatgaacatgttcaaaatgtcattgaaaatatttttgaagatgttttagaactatcttcttctccagaaccagcatattattcgaaactcagttatgaccaaagccccccaggtgataatgtattaaatgtaattcaagagattagcagggattcggcacagtctgttacaacaaaaaaagtatcctcctcaactaacaaaaatatctctgccaaagaaaaagaagaggaagagagagaaaaagagaaagtaagagaggagattaaaagtgaacccagtaaaccagatgatcctcaaaaccaacgagaaagtaaacctggaatttttcccgctaagtttttagaagatgttattactgagatggttaaacaattgatcttttcttctataccagaaacacaaatacaagatagatgtcaaaatgttagtgataagcaaaatcaagccaaactctatgacactgctatgaaactcatcaattcactgttaaaggagttctcagatgctcaaattaaggttttcaggccagataagggaaatcagttccctgggggtaaagtgtcttcagttcctaaagtacctccaaggtataaagagccaactacagatgaagcaccatccagcattaagataaaatctgcagataaaatgccacctatgcataaaatgatgagaaaaccttcttcagataagataccatcaattgacaaaacattggtcaataaagttgttcactcctctgtttgtaatattttaaatgactatggatctcaagactctatttggaagaatataaacagtaatggagaaaatttagcaagaagactaactagtgcagtgataaatgaaattttccaacgtcaggttaacttgatattttgtgatgaggtttcagtttcagcatgtttgcctctggaatctaaggatgttgttaaaaaggtccaaaagttggcccaaacagccagcaaagaatgtcaaacttcatcaccatatacaataatattacctcataaatttttggagaatgtgatttctgctcttttctccaaaattttctcaacaatatccagcacaaaaacaaaagaacctgaggacaatttgtccacagaactgaatttccttcaaatgaagttagtaagtgcagttgcaacagagatctcccaagataaatatatgactatacagtatgtagaaaccttacaatctgatgatgatgaaattattcaattagtggttcagtctgtttataataatctcttgccacagtttggatcacaagagattatacaaaattgtgtaaccagtggatgcaaaatcctttcagaaaacatagttgacttggttctacctaaaccttcacatgctgataagctgtcttataacataatagaagaaattgctgtgaaatttttatcaaagcttttatctatatttccaaaagtacataaagaaagaacaaaatctctagagactgatatgcaaaaaataacttcaaaagtactaaattcagtccaagaatttatctccaaaagtaagattaaacttgtaccacccaccaaggaatcacctactgtgcctgtagctgataatgcaactattgaaaacatagttaattctatttataccagtgttttaaagcactctggctcttatacttctgtatttaaagatttaatgggtaaaagcaatgtcctctctgatacaataggctttttaatggtgaatgcaatttcgaattctgaatttcaacctcaagtagaggaagaagtatcaaattcagaattagttctggaagctgtcaaaattatggaaaaagtgatcaaaattattgatgaacttaagtctaaggaaaagtcttcatccagaaaaggtttgacattagatgccaaacttttagaagaggtgttggccttgttcttggctaaactaataaggttgccaagttcctcaagcaaagatgaaaaaaacttatcaaagactgagttaaataaaattgcatctcaactgtcaaaattggtaacagctgaaatttccagaagtagcattagtctaatagcttctgatcctgaagagcactgtttaaatccagaaaatacagaaaggatttatcaggttgtcgattccgtttatagtaacatactgcaacaatcaggaaccaacaaagaattttattatgatataaaagatacaaatacagcctttcctaaaaaagtggctagtttaattattgatggagtttcaagttttccattaatacaattaactcaacaatttcaaatgctgatctctctggagagctagacgttaatagaattgttcaaaaggcccaagaacatgcttttaatgtgattcctgaattagagcaagaaaagttagatcaaaatttatctgaagaggaatctccaattaaaatagttccacatgttggaaaaaaaccagtcaaaatagatccaaaaattatttcagaacacttagcagttatttctataaaaactcaacctcttgagaaacttaagcaggagtgtttgaaaagaactggacatagcatagcagaactgagaagagcatcaataagtgggagaaattactccttaggatcacctgatttagaaaagagaaagacagaaagacgtacctcattggataagactggaagactggatgtaaaacccctagaggccgttgctagaaattcatttcagaatataagaaagcctgatattacaaaggtggagctcttaaaagatgttcaaagtaaaaatgatcttattgttcgattagtagctcatgatattgatcaagtgtatttggaaaattacataaaagaggaacgagattctgatgaagatgaagttgttttaacacagacttttgcaaaagaagaaggcatcaaagtatttgaagatcaagtgaaagaagtcaagaagccaatacaaagcaaactttctcctaagtcaacactaagcacgagcagcctgaaaaaatttttgtcactaagtaaatgttgtcagaccacagccagtgcaaatattgaaagtactgaagcaatctcaaatcaggtaatagaatccaaggagacacatgttaaaagagctgttgctgagcttgacatggccacaccaaagacgatgcctgaaacagcctcttcatcttgggaggaaaagccccagtgtaagaaagaagaaaagaatcttgttactgaaccaacacattacttcatacacagaattatgagttcatcttcatacaaccaagaagatctcatttcatctactggtgaggctgaagattgtcactcagacccaagtgctaaaatattagaagaaagttctcaggaacaaaagccagagcatggaaacagtgttaagtttatcaccatctttgaaagatccaaggatgttcttggcagtgcaaatccctcaaaggaagtcatttcagaaactcccaagcccgatgtctccaaacaaggatctaaaatgctgacaaaaatgtcttcaactttgtcaaaggtgttttctcaatgtaacaccaatatttccagatcttcctcaccagctcaccaggatgaacactgaagcttttgtacctgatataagtatgcttacttcttttagaaaataaaatggtttttaaagcat

SEQ ID NO: 7794 - DNA, 5419 bp, Homo sapiens
  ENST00000265342
tcacgggctccggtcccggcggcagaaatagggcagccgcggcggcggtggcacagcagcgggcagcggcggctcagggagctggagcctcaacagcctccagcgagcccgggacccgccgacagcccgagaaaccagccgaaggacgcggggcggggtcgccgccgccgccacggggtgctccctccctcccgcccaagtccggccacctggtcttcccctcggccccggccgtctcagactcatcaaaatgaaaccaggaggcttttggctgcatctcacactgctcggagcctccctgccggctgcgctgggatggatggacccaggaaccagcagaggcccggatgtgggtgtgggggagtcacaggcagaggagcccagaagctttgaagtcacaagaagagaagggctttccagccacaacgagctgctggcctcctgcgggaagaagttctgcagccgagggagccggtgcgtgctcagcaggaagacaggggagcccgaatgccagtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggtgacacgtgcaccatggccggctacgcccgcttgaagaatgtccttctggcactccagacccgtctgcagccactccaagaaggagacagcagacaagaccctgcctcccagaagcgcctcctggtggaatctctgttcagggacttagatgcagatggcaatggccacctcagcagctccgaactggctcagcatgtgctgaagaagcaggacctggatgaagacttacttggttgctcaccaggtgacctcctccgatttgacgattacaacagtgacagctccctgaccctccgcgagttctacatggccttccaagtggttcagctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatgcttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtgccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatgaagggcccagagcagagccctgggccaaggaacaccccctagtcctgacactgcagcctcaagcaggtacgctgtacatttttacagacaaaagcaaaaacctgtactcgctttgtggttcaacactggtctccttgcaagtttcctagtataaggtatgcgctgctaccaagattggggttttttcgttaggaagtatgatttatgccttgagctacgatgagaacatatgctgctgtgtaaagggatcatttctgtgccaagctgcacaccgagtgacctggggacatcatggaaccaagggatcctgctctccaagcagacacctctgtcagttgccttcacatagtcattgtcccttactgccagacccagccagactttgccctgacggagtggcccggaagcagaggccgaccaggagcaggggcctccctcccgaactgaaagcccatccgtcctcgcgtgggaccgcatcttctccctcgcagctgcttcttgcttttctttccatttgacttgctgtaagcctgagggagagccaacaagacttactgcatcttgggggatggggaaatcactcactttattttggaaatttttgattaaaaaaaaattttataatctcaaatgctagtaagcagaaagatgctctccgaggtccaactatatccttccctgccttaggccgagtctcgggggtggtcacaaccccacatcccacagccagaaagaacaatggtcatctgagaatactggccctgtcgactattgccaccctgcttctccaagagcagaccaggccacctcatccgtaaggactcggttctgtgttgggaccccaaaaaaccagaacaagttctgtgtgcctcctttcagcacagaagggagacatctcattagtcaggtctggtaccccagattcagggcagactgggcttgcctggcaaggtatgggtggcctccaggctcaatgcagaaaccccaaggacacgagtggggccaggtgagttcctgaagctataccttttcaaaacagattttgttttcctacctgtggcccatccactcctctctggtaccccatccccgcatcagcactgcagagagaacacatttcggcgagggttttcttacccacattccccaatcaatacacacacactgcagaacccagaacagaaggccacaggctggcactactgcattctccttatgtgtctcaggctgtggtgactctcacatgggcatcgaagaagtacaacccacatagccctctggagaccgcctagatcagagactcagcaaaaacaggctcgccttccctctcccacatatgagtggaacttacatgtgtcctggtttgaatgatcattttgcaagccacacgggttgggagaggtggtctcaccacagacgtctttgctaatttggccaccttcacctactgacatgaccaggattttcctttgccattaaggaatgaactctttcaaggagaggaaaccctagactctgtgtcactctcaacacacacagctcctttcactcctgcctgactgccaagccacctgcatcccccgccccagatctcatgagatcaatcacttgtatgtctcacgcaacttggtccaccaaacgcctgtcccctgtaactcctaggggtgcgcctagacaggtacgtctgttttttattttaaaagatatgctatgtagatataagttgaggaagctcacctcaaaagcctagaatgcagtttcacagtagctgggatgcatggatgacccatctcacccctttttttttcctgcctcaatatcttgatatgttatgtttactcccaatctcccatttttaccactaaaattctccaactttcataaacttttttttggaaaaatttccattgtatcagcccctgacagaaaaaggatctctgagcctaaaggaggaaaagtcccaccaactaccagaccagaacacgagcccctctgggcagcaggattcctaagtcaaagaccagtttgacccaaactggccttttaaaataatcaggagtgacagagtcaacttctgcagcacctgcttctcccccactgtcccttccatcttggaatgtgtctaaaaaagcatagctgccctttgctgtcctcagagtgcatttcctggagacggcaggcttaggtctcactgacagcatgccagacacaactgaatcgaagcaggcctgaagcctaggtcagggtttcaggagtccagccccaggaggcaaagtcaccaatgcagggaggtaaatgccttttggcaggaaaaccaatagagttggttgggtggggagtcaggggtgggaggagaaggaggaagaggaggaaggccagactggcctgccctttctcccatacttcaccccagcagaggttcatgggacacagttggaaagccactgggaggaaatgcctcactacaggggggcctcctgtagcaagcccagccggtaatcctcctaatgaacccacaaggtcaattcacaactgatatcttagctattaaagaagtactgactttaccaaaagaatcatcaagaaagctatttatataaaccccctcagtcattttgaaataaaattaattttacaaaaa

SEQ ID NO: 7795 - DNA, 2374 bp, Homo sapiens
  ENST00000509525
acctacttgggttcaccccctctggagcagggtctcaggttgggccacaggcccaagtccaggtcagggccgtctctttctcaccagcactgactctcacccacagtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggaattgcatctcgtgcctgcaccagatgcatccacgtggccggtttcttgtgtgttcaatgctgcgtgtgaccctgcccaggggccgactgcttggagggcatgcccattccatttgctcctcccaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtgccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatgaagggcccagagcagagccctgggccaaggaacaccccctagtcctgacactgcagcctcaagcaggtacgctgtacatttttacagacaaaagcaaaaacctgtactcgctttgtggttcaacactggtctccttgcaagtttcctagtataaggtatgcgctgctaccaagattggggttttttcgttaggaagtatgatttatgccttgagctacgatgagaacatatgctgctgtgtaaagggatcatttctgtgccaagctgcacaccgagtgacctggggacatcatggaaccaagggatcctgctctccaagcagacacctctgtcagttgccttcacatagtcattgtcccttactgccagacccagccagactttgccctgacggagtggcccggaagcagaggccgaccaggagcaggggcctccctcccgaactgaaagcccatccgtcctcgcgtgggaccgcatcttctccctcgcagctgcttcttgcttttctttccatttgacttgctgtaagcctgagggagagccaacaagacttactgcatcttgggggatggggaaatcactcactttattttggaaatttttgattaaaaaaaaattttataatctc

SEQ ID NO: 7796 - DNA, 571 bp, Homo sapiens
  ENST00000511375
aacagaatgaggctctggggtccagaagggaggctgaagaatagtgtcaaagcaagcagcagatgttagccaatgaagaaggagaagcagcagcaattatatctcaagtctcctgtgtgagaccaggacctcttcccagcattctaaatgcaagacatctcaacagcccagcatgtcagagtggcatcccgtaggatgtctgctttctctcatcagtcctggagtcgcacctcagagaatgcctgtgagcagcatccgacagagactaccaacaaactggcccaggcatctggcaccagagaaaaatgaactcccagtagacagttccaccacgtgacattttcatgattgacagccctctcccactttccctagcctggcttacatgttgagaaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgc

SEQ ID NO: 7797 - DNA, 817 bp, Homo sapiens
  ENST00000507112
gatcagacgtgcagggaaaatctgattccttttgtaactaacctgactttacaagcctcaccccaatgggagaaaagcacaactaaatgctcaatccattgtaaagattagcacgagctgacgattttaacagtccacaagtggttcagctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatgcttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccgcctcagcgtgggaaacatgttctatgtcttctccgacgacggtatcatcgtcatccatcctgtggactgtgagatccagaggcacctcaaacc

SEQ ID NO: 7798 - DNA, 488 bp, Homo sapiens
  ENST00000514998
cagaaaacaaagatctcctgttggcactcaggcttcctcctgctctaggtgacacgtgcaccatggccggctacgcccgcttgaagaatgtccttctggcactccagacccgtctgcagccactccaagaaggagacagcagacaagaccctgcctcccagaagcgcctcctggtggaatctctgttcagggacttagatgcagatggcaatggccacctcagcagctccgaactggctcagcatgtgctgaagaagcaggacctggatgaagacttacttggttgctcaccaggtgacctcctccgatttgacgattacaacagtgacagctccctgaccctccgcgagttctacatggccttccaggaaagctggtgaatttgttctgcaacaagcctgagctttaagaaaagactaaacggagagtggatggggccagagagggcttgccctgttcctttttaataaagatttttctcgctcttt

SEQ ID NO: 7799 - DNA, 716 bp, Homo sapiens
  ENST00000510685
ccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctggccccttgcgcttcccaggtgaggcaatgcctcgccctgcttcggctcgcgcacggtgcgcacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctggggccttgatcttaaggaggaggagcccagaagctttgaagtcacaagaagagaagggctttccagccacaacgagctgctggcctcctgcgggaagaagttctgcagccgagggagccggtgcgtgctcagcaggaagacaggggagcccgaatgccagtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggtgacacgtgcaccatggccggctacgcccgcttgaagaatgtccttctggcactc

SEQ ID NO: 7800 - DNA, 2660 bp, Homo sapiens
  ENST00000621681
gactcatcaaaatgaaaccaggaggcttttggctgcatctcacactgctcggagcctccctgccggctgcgctgggatggatggacccaggaaccagcagaggcccggatgtgggtgtgggggagtcacaggcagaggagcccagaagctttgaagtcacaagaagagaagggctttccagccacaacgagctgctggcctcctgcgggaagaagttctgcagccgagggagccggtgcgtgctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatgcttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtgccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatgaagggcccagagcagagccctgggccaaggaacaccccctagtcctgacactgcagcctcaagcaggtacgctgtacatttttacagacaaaagcaaaaacctgtactcgctttgtggttcaacactggtctccttgcaagtttcctagtataaggtatgcgctgctaccaagattggggttttttcgttaggaagtatgatttatgccttgagctacgatgagaacatatgctgctgtgtaaagggatcatttctgtgccaagctgcacaccgagtgacctggggacatcatggaaccaagggatcctgctctccaagcagacacctctgtcagttgccttcacatagtcattgtcccttactgccagacccagccagactttgccctgacggagtggcccggaagcagaggccgaccaggagcaggggcctccctcccgaactgaaagcccatccgtcctcgcgtgggaccgcatcttctccctcgcagctgcttcttgcttttctttccatttgacttgctgtaagcctgagggagagccaacaagacttactgcatcttgggggatggggaaatcactcactttattttggaaatttttgattaaaaaaaaattttataatctc

SEQ ID NO: 7801 - DNA, 4757 bp, Homo sapiens
  ENST00000379164
gtactgtccactgtgctgtcggtgctgaacctgagacgcgagcggaccagttgctccagcacctgaaggcaacgccctcttgcaccctctgtgccctgtgggacccgcttcaccaacaggacccatatcaacttgacaaaggagtgtggtatcggacgtgggagagagtcctctgtttgccacctgggcgctcattcaggcgtgactttggagatttctatagttttagaccaaactatttttttttccccagctaagacgatcttttgagagttttttttttttattgtgatttatatttccacagcgtttaggaatctttctgggggacttttgtgactgttaaaataaggtgaaaagcaataaggatgtttaagtgctggtcagttgtcttggttctcggattcatttttctggagtcggaaggaaggccaaccaaagaaggaggatatggccttaaatcctatcagcctctaatgagattgcgacataaggaaaaaaatcaagaaagttcaagagtcaaaggatttatgattcaggatggcccttttggatcttgtgaaaataagtactgtggtttgggaagacactgtgttaccagcagagagacagggcaagcagaatgtgcctgtatggacctttgcaaacgtcactacaaacctgtgtgtggatctgacggagaattctatgaaaaccactgtgaagtgcacagagctgcttgcctgaaaaaacaaaagattaccattgttcacaatgaagactgcttctttaaaggagataagtgcaagactactgaatacagcaagatgaaaaatatgctattagatttacaaaatcaaaaatatattatgcaagaaaatgaaaatcctaatggcgacgacatatctcggaagaagctattggtggatcaaatgtttaaatattttgatgcagacagtaatggacttgtagatattaatgaactaactcaggtgataaaacaggaagaacttggcaaggatctctttgattgtactttgtatgttctattgaaatatgatgattttaatgctgacaagcacctggctcttgaagaattttatagagcattccaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagaccctagctaacatattatggagagaagaaggtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagacatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaaaaaccctacgatacaattattgaatgaagcgttttacaatacattgcacttaatccattgtttaaatttacaacttaactttccaagtttatatcctagtcaaacaaaatttacttggttggtccaaataaaataaattgtttttgactaagtgactaagacatacacaattaattatattggttaattagaaatactcagcacaatatttaatgagaaatcacatcagtcacaagaatcaaatatgtaaattatgctttaaacaataaagtaggatttaaatcatttaaaaaactaaactgcagggaatttcagatgacataaagcattatttcattttgagggtagtttattttttttctctgtccttttggtatgattaaacaagaaataaaaggtgttgtggaaacttaaaattcttaattcaaaatattcggtcctgtccactgtttataatattttgtgccttgaagggaatgtcacaggaggaaaaggaagactaaagcctgcatactaaatgctctcataactataaatctcttgttgttaaaaaacatctcttgcaccaaatcctgtcttcagtcttttgtttaaccctcaatgaactaccaattgaaggcataagttggtcttaggttgtatacaggtgtcaaactccacttgacatttactgtataatctgcagcatgctatagaaagtggggaggaagggaggaaaaataattacagtcaaaatatttgcaatctatctactcattttgctttcaatcactagagtgcattatgtttttaatgcaagtttgtctgggatgtcaactgcctacagatgtttattactagcagaatagattatttattaatagattgtttcttttcatatagtccaatgtttcatcatcaggaactttcggttttaaaaaagaaacattacttttgtctgctaaagtaaaccatatatagggaaattaacacctaggaaaagaaaactggcaagagaattgatgaggtattagtggcttagaagaattagtaatataagttgggaataaaggggtagcccgacagtggtaagtaaaaatgtagtactccattgtttttgctatttaaatataatgtatcaaaaacctttattctaaaatttccacaaatgattccttttatccatcttcttgtaatcctaaaagcatcttctcactatgtgctgtagtttgaaacctaacgaatcctcctacttgagacactgtagaaaagtaaaaattgttgcttctgttttgttttaagaggaaatgagaaggccagcagaagtagattaaaactagagagctggtttattaaaataagcagataattatccaggcttaaagtaatagcttacatgttttgaaaatccttgtacttatttttgtttttattgttgcaaaaaaatgttaatgggctgttgaaatgacctccatttacttaaggtaatccaataaggtcttttttaaatatacaaattttactcaagtttaaattgtataaaactgcttagaaacctgaaattttatagtgtgtaatatcttatgtgtatatagcatcctgagctgtgtgatacagtagatttcttcttagcagaaacatgcgaggtagatttaataaacaacaaaaatcagcttatgtttctacttattgaatctgctttactttttagcaattttcttccttgtgaacatgaaccatataaagtgtctgtgacttaatgatttcatgtaagtctgtcgcatacatccttcttttgtagcttacaccatgtggatgctctgtctgtagacactgcttgataaaaggagaataaacctcttacatttt

SEQ ID NO: 7802 - DNA, 2920 bp, Homo sapiens
  ENST00000427802
gttcagtgactgagacaaactggaggtgaaaggagctggtactgtccactgtgctgtcggtgctgaacctgagacgcgagcggaccagttgctccagcacctgaaggcaacgccctcttgcaccctctgtgccctgtgggacccgcttcaccaacaggacccatatcaacttgacaaaggagtgtggtatcggacgtgggagagagtcctctgtttgccacctgggcgctcattcaggcgtgactttggagatttctatagttttagaccaaactatttttttttccccagctaagacgatcttttgagagttttttttttttattgtgatttatatttccacagcgtttaggaatctttctgggggacttttgtgactgttaaaataaggtgaaaagcaataaggatgtttaagtgctggtcagttgtcttggttctcggattcatttttctggagtcggaaggaaggccaaccaaagaaggaggatatggccttaaatcctatcagcctctaatgagattgcgacataaggaaaaaaatcaagaaagttcaagagtcaaaggatttatgattcaggatggcccttttggatcttgtgaaaataagtactgtggtttgggaagacactgtgttaccagcagagagacagggcaagcagaatgtgcctgtatggacctttgcaaacgtcactacaaacctgtgtgtggatctgacggagaattctatgaaaaccactgtgaagtgcacagagctgcttgcctgaaaaaacaaaagattaccattgttcacaatgaagactgcttctttaaaggagataagtgcaagactactgaatacagcaagatgaaaaatatgctattagatttacaaaatcaaaaatatattatgcaagaaaatgaaaatcctaatggcgacgacatatctcggaagaagctattggtggatcaaatgtttaaatattttgatgcagacagtaatggacttgtagatattaatgaactaactcaggtgataaaacaggaagaacttggcaaggatctctttgattgtactttgtatgttctattgaaatatgatgattttaatgctgacaagcacctggctcttgaagaattttatagagcattccaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagacccgtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagacatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaa

SEQ ID NO: 7803 - DNA, 404 bp, Homo sapiens
  ENST00000511999
ccatagaatgtgaatttcagaggcacattaagcctagtgaaaagctccttggatttcagttgtacacatgatttcatcttgtcacctggagtatgaacttcaagcaaatagaattctatttcagacttatggattcagaagtcaaactgaaaaggagtttggaaaaatgtttaaaattacaggctcaaaaacaagctttcccaagattaccaactttgtcactcttctggttttctactactgttccatccttatctatcactcttttattctttgatacttttacattcagccaccttctttgcttgttatagatctagctgctgcttttcacatatgccatggtattacttattatttaatgggtcctaaaataactttaaagaaaaccacgtgtcttatta

SEQ ID NO: 7804 - DNA, 558 bp, Homo sapiens
  ENST00000511170
cttcttcctcattttctcttgcgctgccatgtaagaactgcctttcacctcccacaatgattctgaggcctccccagacatgtggaattaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgtacatcaataaagtagaagtagcttggaatgcaggaggaaattgaacatctcatctaaaaagttttcctttggggagtatcagtgaccatttcctccagtcatccgggtgtatccagagagtcaggctagagagcctggggtaactgccagtcttaggtgccatgcagagggcataccaaa

SEQ ID NO: 7805 - DNA, 4831 bp, Homo sapiens
  ENST00000306100
tgcctagggaggaggagcgagaatcagcctggttcagtgactgagacaaactggaggtgaaaggagctggtactgtccactgtgctgtcggtgctgaacctgagacgcgagcggaccagttgctccagcacctgaaggcaacgccctcttgcaccctctgtgccctgtgggacccgcttcaccaacaggacccatatcaacttgacaaaggagtgtggtatcggacgtgggagagagtcctctgtttgccacctgggcgctcattcaggcgtgactttggagatttctatagttttagaccaaactatttttttttccccagctaagacgatcttttgagagttttttttttttattgtgatttatatttccacagcgtttaggaatctttctgggggacttttgtgactgttaaaataaggtgaaaagcaataaggatgtttaagtgctggtcagttgtcttggttctcggattcatttttctggagtcggaaggaaggccaaccaaagaaggaggatatggccttaaatcctatcagcctctaatgagattgcgacataagcaggaaaaaaatcaagaaagttcaagagtcaaaggatttatgattcaggatggcccttttggatcttgtgaaaataagtactgtggtttgggaagacactgtgttaccagcagagagacagggcaagcagaatgtgcctgtatggacctttgcaaacgtcactacaaacctgtgtgtggatctgacggagaattctatgaaaaccactgtgaagtgcacagagctgcttgcctgaaaaaacaaaagattaccattgttcacaatgaagactgcttctttaaaggagataagtgcaagactactgaatacagcaagatgaaaaatatgctattagatttacaaaatcaaaaatatattatgcaagaaaatgaaaatcctaatggcgacgacatatctcggaagaagctattggtggatcaaatgtttaaatattttgatgcagacagtaatggacttgtagatattaatgaactaactcaggtgataaaacaggaagaacttggcaaggatctctttgattgtactttgtatgttctattgaaatatgatgattttaatgctgacaagcacctggctcttgaagaattttatagagcattccaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagaccctagctaacatattatggagagaagaaggtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagacatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaaaaaccctacgatacaattattgaatgaagcgttttacaatacattgcacttaatccattgtttaaatttacaacttaactttccaagtttatatcctagtcaaacaaaatttacttggttggtccaaataaaataaattgtttttgactaagtgactaagacatacacaattaattatattggttaattagaaatactcagcacaatatttaatgagaaatcacatcagtcacaagaatcaaatatgtaaattatgctttaaacaataaagtaggatttaaatcatttaaaaaactaaactgcagggaatttcagatgacataaagcattatttcattttgagggtagtttattttttttctctgtccttttggtatgattaaacaagaaataaaaggtgttgtggaaacttaaaattcttaattcaaaatattcggtcctgtccactgtttataatattttgtgccttgaagggaatgtcacaggaggaaaaggaagactaaagcctgcatactaaatgctctcataactataaatctcttgttgttaaaaaacatctcttgcaccaaatcctgtcttcagtcttttgtttaaccctcaatgaactaccaattgaaggcataagttggtcttaggttgtatacaggtgtcaaactccacttgacatttactgtataatctgcagcatgctatagaaagtggggaggaagggaggaaaaataattacagtcaaaatatttgcaatctatctactcattttgctttcaatcactagagtgcattatgtttttaatgcaagtttgtctgggatgtcaactgcctacagatgtttattactagcagaatagattatttattaatagattgtttcttttcatatagtccaatgtttcatcatcaggaactttcggttttaaaaaagaaacattacttttgtctgctaaagtaaaccatatatagggaaattaacacctaggaaaagaaaactggcaagagaattgatgaggtattagtggcttagaagaattagtaatataagttgggaataaaggggtagcccgacagtggtaagtaaaaatgtagtactccattgtttttgctatttaaatataatgtatcaaaaacctttattctaaaatttccacaaatgattccttttatccatcttcttgtaatcctaaaagcatcttctcactatgtgctgtagtttgaaacctaacgaatcctcctacttgagacactgtagaaaagtaaaaattgttgcttctgttttgttttaagaggaaatgagaaggccagcagaagtagattaaaactagagagctggtttattaaaataagcagataattatccaggcttaaagtaatagcttacatgttttgaaaatccttgtacttatttttgtttttattgttgcaaaaaaatgttaatgggctgttgaaatgacctccatttacttaaggtaatccaataaggtcttttttaaatatacaaattttactcaagtttaaattgtataaaactgcttagaaacctgaaattttatagtgtgtaatatcttatgtgtatatagcatcctgagctgtgtgatacagtagatttcttcttagcagaaacatgcgaggtagatttaataaacaacaaaaatcagcttatgtttctacttattgaatctgctttactttttagcaattttcttccttgtgaacatgaaccatataaagtgtctgtgacttaatgatttcatgtaagtctgtcgcatacatccttcttttgtagcttacaccatgtggatgctctgtctgtagacactgcttgataaaaggagaataaacctcttacattttaa

SEQ ID NO: 7806 - DNA, 530 bp, Homo sapiens
  ENST00000529191
agacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatggtcctggtgcatctcatccacagccaacagggacacctggtcaccagggacagaagaagtcccacagaaagatcatcccaggcaggaccttgtatgtgcctgatgacttggaggaatctctccctctctctggacctcagtttccctgcctgtgaaatggggagatgggtgcctgcctgcagcctcaaagattgaggtgagaatcctgtg

SEQ ID NO: 7807 - DNA, 507 bp, Homo sapiens
  ENST00000529631
agacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgccaacagggacacctggtcaccagggacagaagaagtcccacagaaagatcatcccaggcaggaccttgtatgtgcctgatgacttggaggaatctctccctctctctggacctcagtttccctgcctgtgaaatggggagatgggtgcctgcctgcagcctcaaagattgaggtgagaatcctgtg

SEQ ID NO: 7808 - DNA, 550 bp, Homo sapiens
  ENST00000530019
agacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagccaacagggacacctggtcaccagggacagaagaagtcccacagaaagatcatcccaggcaggaccttgtatgtgcctgatga

SEQ ID NO: 7809 - DNA, 1229 bp, Homo sapiens
  ENST00000273550
ataagagaccacaagcgacccgcagggccagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaggtgttgtctttgaggtcttgggatgaatcagaaatctatccaggctatcttccagattccttaagtgccgttgttcagttctaatcacactaatcaaaaagaaacgagtatttgtatttattaaactcattagtttgggcagtatactaaggtgtggctgtcttggattcagatagaactaagggttcccgactctgaatccagagtctgagttaaatgtttccaatggttcagtctagctttcacagtttttatgaataaaaggcattaaaggctgaa

SEQ ID NO: 7810 - DNA, 912 bp, Homo sapiens
  ENST00000532829
agacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccc

SEQ ID NO: 7811 - DNA, 983 bp, Homo sapiens
  ENST00000534180
ccagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgatcgtcacagctacctgtctctggggatccctagtataacacattcagtgttcccctttcagtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccc

SEQ ID NO: 7812 - DNA, 786 bp, Homo sapiens
  ENST00000526640
ggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcagtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaa

SEQ ID NO: 7813 - DNA, 742 bp, Homo sapiens
  ENST00000532601
ggacttctctggcgcagaaagtcggggcagctggttcttctcggctgtaccctgagaatgctccctcctaggccagggccgcctctgcacacccttcttttttaaggagaccttggtgtcctgaaatcctggggttgcaagactgccagcctgtgtgatcaatcctgcggttaggaagtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatt

SEQ ID NO: 7814 - DNA, 788 bp, Homo sapiens
  ENST00000534719
gcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatgtgagtattggaaccccaggaaataaatggaggaaatcatttgccttagggattgggaaagctgcccactaactgtcttccccattgttttgcagttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggag

SEQ ID NO: 7815 - DNA, 885 bp, Homo sapiens
  ENST00000533138
gtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaaggtgaacaaaagatcctaggggtgtcatacttcatcatctggcagtgttcgggtatcagaaatcacttaaactagcaattgcccttataaagtgatgatacactgggcttttgccttttgtgcttttttaggcttaccatctaaactaaattaggcaaatagtaatgtcccttttgccaaaacgtggtggttagagatgatgggcttgctgacttctaggttagttggtagagatgcattaacctattctcattcagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaa

SEQ ID NO: 7816 - DNA, 567 bp, Homo sapiens
  ENST00000529548
agacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccatcaaccgccagatcaacctggagctctacgcctcctacgtttacctgtccatgatcgtcacagctacctgtctctggggatccctagtataacacattcagtgttcccctttcagtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgaccccc

SEQ ID NO: 7817 - DNA, 825 bp, Homo sapiens
  ENST00000620041
agacgttcttcgccgagagtcgtcggggtttcctgcttcaacagtgcttggacggaacccggcgctcgttccccaccccggccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccc

SEQ ID NO: 7818 - DNA, 878 bp, Homo sapiens
  ENST00000331825
gtcccctcgcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgc

SEQ ID NO: 7819 - DNA, 592 bp, Homo sapiens
  ENST00000351325
ctgggccagggggtccaaagtgctcagcccccggggcacagcaggacgtttgggggccttctttcagcaggggacagcccgattggggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgacagcactttgtcggtctcggtccctcagcgcgaaacgccagcgccactgggccccagca

SEQ ID NO: 7820 - DNA, 959 bp, Homo sapiens
  ENST00000592818
gggcacagcaggacgtttgggggccttctttcagcaggggacagcccgattggggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagtgagtgcccctagctcccgccctctaccccgcctctccctggccccacctctctctggccccgcctctccctggccccgcctctccctagcccccctctccctggccccgcttctccctggtcccgcccctccctggccccgccccgccccaacccctcccaggccttgccccgcctaccctgccttggttccccggcccccggtctcgcctctagccccgccccgtcccccaagccccgcccctcgcgagggcgagctggagctacagcgccgcttggcgcccgccgggagggagcctcagcttctcctacctctccacgcccacaggcagaagatgccggtgcaagttcaaccagcagcagaggactggggaacccgatgaagaggagggaactttccgcagctccatccgccgtctgtccacccgcaggcggtagaaacacctggagcgatggaatccggccaggtgctgcagctctgacacggcggtgggagggaaggagggaggaaggaaaggcgggagagggagggggccaagtgccagagttgaagggcggcgaggggtggggctggacgtcccccctcgcctctcacccttttcaccctcacaggactcccctggcacctgacatctcccacgctccacctgcgcgcccaccgccccctccgccgccccttccccagccctgcccccgcagactccccctgccgccaagacttccaataaaac

SEQ ID NO: 7821 - DNA, 428 bp, Homo sapiens
  ENST00000589209
tgtgtagggctggttgcgtcactgcgtgggggcaccggaggcccagaggaggagtattggatgcctgacggtgtttacaccccacgtcctgctccaaccagcagtttggggagaggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccagg

SEQ ID NO: 7822 - DNA, 594 bp, Homo sapiens
  ENST00000455515
agggaggagacggggtgacctttcccacaggggcagcctgtggcgatgtggcagctgggcctcaccccggcagggctgtgcgtgaccccctgagtgggggaaggcaggctgttgccatggtggcctgagcgagcagaattcctccagggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcga

SEQ ID NO: 7823 - DNA, 486 bp, Homo sapiens
  ENST00000588715
ctctgtgtttgtgtgaggcagcgcctcctctgccctgccagggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctc

SEQ ID NO: 7824 - DNA, 619 bp, Homo sapiens
  ENST00000588607
gtgaggcagcgcctcctctgccctgccaggctggggatacccgtttctctagcttggagccaccaagatagaggacaaacacttctgtgattcagtccccagactgtctctgacttaatcccttgggttcaagccctatgtgggagagcaagggcacacactgcctaatccgtggtgtcccccccaggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacg

SEQ ID NO: 7825 - DNA, 379 bp, Homo sapiens
  ENST00000587056
acgaagctggggatacccgtttctctagcttggagccaccaagatagaggacaaacacttctgtgattcagtccccagactgtctctgacttaatcccttgggttcaagccctatgtgggagagcaagggcacacactgcctaatccgtggtgtcccccccaggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagtgagtgcccctagctcccgccctctaccccgcctctccctgg

SEQ ID NO: 7826 - DNA, 645 bp, Homo sapiens
  ENST00000588081
ccctatgtgggagagcaagggcacacactgcctaatccgtggtgtcccccccaggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggtgctgcagctctgacacggcggtgggagggaaggagggaggaaggaaaggcgggagagggagggggccaagtgccagagttgaagggcggcgaggggtggggctggacgtcccccctcgcctctcacccttttcaccctcacaggactcccctggcacctgacatctcccacgctccacctgcgcgcccaccgccccctccgccgccccttccccagccctgcccccgcagactccccctgccgccaagacttccaataaaacgtgcgttcctctcga

SEQ ID NO: 7827 - DNA, 512 bp, Homo sapiens
  ENST00000589121
ttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgaccccgcccctcgcgagggcgagctggagctacagcgccgcttggcgcccgccgggagggagcctcagcttctcctacctctccacgcccacaggcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgaca

SEQ ID NO: 7828 - DNA, 620 bp, Homo sapiens
  ENST00000590462
gcatctcgtggcccatcctctgcttcttcccgtcttctctcccccctgtcctcctcctccctgtcccctccctccctttcctatacacccctttcctctccctggtaccccactttcctcctcccatatctgctcccccttaattatcttacttccccccttctgcctgctggtcctttctccctgttccctccttcccaatttacccctctcctattctccctcctgtcttccctgccctcaccttccctgctctgctgctcacagactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgacagca

SEQ ID NO: 7829 - DNA, 690 bp, Homo sapiens
  ENST00000612146
ggccaacccaagagggagggagtgtggttgaggcagtgggttctgcagggtgggatgtgggtgactcctccctgccctgctggtgcgtgtgcaccctggcagggtgtggagttgggacacacacgtgtgtagggctggttgcgtcactgcgtgggggcaccggaggcccagaggaggagtattggatgcctgacggtgtttacaccccacgtcctgctccaaccagcagtttggggagaggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgacagc

SEQ ID NO: 7830 - DNA, 456 bp, Homo sapiens
  ENST00000586063
ccccacatcggtccgtcctgcttccagctgctgcagcgcgccttcgccgccaaagcatccagcagccccctgctccggcccagcatggcgaccccgacccagacccccacaaaggctcctgaggaacctgacccattttactatgactacaacacggtgcagactgtgggcatgactctggcaaccatcttgttcctgctgggtatcctcatcgtcatcagcaagaaggtgaagtgcaggaaggcggactccagcccaacctgcaaatcctgtaagtctgagcttccctcttcagcccctggtggcggcggcgtgtaacaccttcccgaggaaactccgctgccgaccctgcctgagcgcgggagcctgaggaccgggtggaggcggtggggacccagccgcgcgccgggagcgctccccggaatgagccgccccacccaccccaaggctggagcc

SEQ ID NO: 7831 - DNA, 712 bp, Homo sapiens
  ENST00000270310
ccccacatcggtccgtcctgcttccagctgctgcagcgcgccttcgccgccaaagcatccagcagccccctgctccggcccagcatggcgaccccgacccagacccccacaaaggctcctgaggaacctgacccattttactatgactacaacacggtgcagactgtgggcatgactctggcaaccatcttgttcctgctgggtatcctcatcgtcatcagcaagaaggtgaagtgcaggaaggcggactccaggtctgagagcccaacctgcaaatcctgtaagtctgagcttccctcttcagcccctggtggcggcggcgtgtaacaccttcccgaggaaactccgctgccgaccctgcctgagcgcgggagcctgaggaccgggtggaggcggtggggacccagccgcgcgccgggagcgctccccggaatgagccgccccacccaccccaaggctggagccgctgcaccctgctgtccctctccaggccttggcaatgacgatcccccaaagagcccgtctgcaccccagacccagggcctcaggcctccagctcctgggatccgggagtccatcccggcccagcacccccagcatccccgtgtatggcccccctgcacctccttgtctcatccccgaagatccgtccccctggcccctcagtgtccatgtcttgagcttaataaatgtgcatttggttttttcctct

SEQ ID NO: 7832 - DNA, 1111 bp, Homo sapiens
  ENST00000439441
atcggtccgtcctgcttccagctgctgcagcgcgccttcgccgccaaagcatccagcagccccctgctccggcccagcatggcgaccccgacccagacccccacaaaggctcctgaggaacctgacccattttactatggtgagtgttggatttggggatagggctggactggggagtagctgcaggtgctcacagatcactccggacatggcttcagctgtggccacacgatacgtgctgggccactggccacgggaccatatatgtgggtgtggttcacatcagctgagttcatggagggcagaaccagatgggggagtggggatgcctcacactctctctgagcccccttcaggtctcaccgggatctgggctggtgccttggtgtcgccagagaagcagatgaaggaaaaccttagaagcaatgactctgagcccaggctgcctggatttgaatcctgccttatccactcactagctgtatggccttgggcaagcaactttgcctctctgggcccttctgtaaacaagggatagtaatagttcccacctatgaggactgtgggaaagatacctgactggtggcattaaatctcctccatggcactgaagctcaaataagctaccccaggcctggtagatcgggctccagtttcccctctgaacaccctcctcttgcccccaccccacccctttgctcattcatactttttccctaggtgtcaatttctctcccatctcaggacctttgcgtgtgctatgattctgcagtaatgcttctcctttgtacacgaccggctaaggctcccccttattcaggcctcagatcaaacatagactactctactgggataggccctcctgactccctggcaaggaagagccacaccatactcagctggtgtcgcatgacttgtttttgagggggattgtttctttaatgttttatcacaatacgaaagtcaactccttgctggtagaggcctggaccactactggtacagagtgagtgctccataaattcatatctcaacaaatacttagcgggcacaggctctatttctggcaatgttccaagcagctggagacactgcaatgaaccacacagac

SEQ ID NO: 7833 - DNA, 636 bp, Homo sapiens
  ENST00000588265
gctgcagcgcgccttcgccgccaaagcatccagcagccccctgctccggcccagcatggcgaccccgacccagacccccacaaaggctcctgaggaacctgacccattttactatgactacaacacggtgcagactgtgggcatgactctggcaaccatcttgttcctgctgggtatcctcatcgtcatcagtaagtgcgacccattcctgggctgcctcagcctccgcttcctctgctggctttcatccatatcctacccgctatgtcctgtcttcttgttctgtctctctctcccaacaggcaagaaggtgaagtgcaggaaggcggactccaggtctgagagcccaacctgcaaatcctgtaagtctgagcttccctcttcagcccctggtggcggcggcgtgtaacaccttcccgaggaaactccgctgccgaccctgcctgagcgcgggagcctgaggaccgggtggaggcggtggggacccagccgcgcgccgggagcgctccccggaatgagccgccccacccaccccaaggctggagccgctgcaccctgctgtccctctccaggccttggcaatgacgatcccccaaagagcccgtctgcaccccagacccagggcctcaggcctcc

SEQ ID NO: 7834 - DNA, 3859 bp, Homo sapiens
  ENST00000286201
ctctcccaaccgcctcgtcgcactcctcaggctgagagcaccgctgcactcgcggccggcgatgcgggaccccggcgcggccgctccgctttcgtccctgggcctctgtgccctggtgctggcgctgctgggcgcactgtccgcgggcgccggggcgcagccgtaccacggagagaagggcatctccgtgccggaccacggcttctgccagcccatctccatcccgctgtgcacggacatcgcctacaaccagaccatcctgcccaacctgctgggccacacgaaccaagaggacgcgggcctcgaggtgcaccagttctacccgctggtgaaggtgcagtgttctcccgaactccgctttttcttatgctccatgtatgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttctttgcagatttggggcgaggggtgatttggaaaagaagacctgggtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatacaaaatgaa

SEQ ID NO: 7835 - DNA, 4030 bp, Homo sapiens
  ENST00000374694
gggaagttgggctaagggcgctgctcccgccgaggaggaggcggcggctgggcgcgggccgcgccactcaggtgtccgctccgccttccggtctggatttgctcctgggtgtccagcaggaaggagactgtgtgcacctcgcccgactgcggccggagcgcggcgctgacttttccaggcggcgggggtccgtctgtcccggcggcggacggacgaaggacggacgccggagaaagagggcggcggcctgggccgaggcgggtccccaactccggcggcggcggcggcggcttggccttgggggcgggcatgagcccccgggggccgagtggtggccgccagggctgacccggcgcggcaagcggcccggcccagccatcttgactgcgcaccgcggccccagaggaaacttgcggcgcctccgccctctctgtccggcggagtcaccgccgcccggcgcggcggggagaagtggtcgggcgcgcggagaggaggcgagcgagcgcgggacgatgagccgaggcccggccgctctgcgccgcgagggctgagcgcgacccggggccagcagagcggacctacggactgtggcgcgcgcctgcagccgccttcaaacccccggagcggcggaaaggagtgcggaagggccctgcccaggctgcgggccgcgccgctgcggacgcgcccctagaaggggttagattatcggcagacccccctcccgggcgaagcataagggagaccccagatcacccgctgtacccgtctgcggctctctcgtgggccccccccccggcacccctctgcgcgccgcctggagggcgagggcaccgggccgaggcgcacagcatggagtggggttacctgttggaagtgacctcgctgctggccgccttggcgctgctgcagcgctctagcggcgctgcggccgcctcggccaaggagctggcatgccaagagatcaccgtgccgctgtgtaagggcatcggctacaactacacctacatgcccaatcagttcaaccacgacacgcaagacgaggcgggcctggaggtgcaccagttctggccgctggtggagatccagtgctcgcccgatctcaagttcttcctgtgcagcatgtacacgcccatctgcctagaggactacaagaagccgctgccgccctgccgctcggtgtgcgagcgcgccaaggccggctgcgcgccgctcatgcgccagtacggcttcgcctggcccgaccgcatgcgctgcgaccggctgcccgagcaaggcaaccctgacacgctgtgcatggactacaaccgcaccgacctaaccaccgccgcgcccagcccgccgcgccgcctgccgccgccgccgcccggcgagcagccgccttcgggcagcggccacggccgcccgccgggggccaggcccccgcaccgcggcggcggcaggggcggtggcggcggggacgcggcggcgcccccagctcgcggcggcggcggtggcgggaaggcgcggccccctggcggcggcgcggctccctgcgagcccgggtgccagtgccgcgcgcctatggtgagcgtgtccagcgagcgccacccgctctacaaccgcgtcaagacaggccagatcgctaactgcgcgctgccctgccacaacccctttttcagccaggacgagcgcgccttcaccgtcttctggatcggcctgtggtcggtgctctgcttcgtgtccaccttcgccaccgtctccaccttccttatcgacatggagcgcttcaagtacccggagcggcccattatcttcctctcggcctgctacctcttcgtgtcggtgggctacctagtgcgcctggtggcgggccacgagaaggtggcgtgcagcggtggcgcgccgggcgcggggggcgctgggggcgcgggcggcgcggcggcgggcgcgggcgcggcgggcgcgggcgcgggcggcccgggcgggcgcggcgagtacgaggagctgggcgcggtggagcagcacgtgcgctacgagaccaccggccccgcgctgtgcaccgtggtcttcttgctggtctacttcttcggcatggccagctccatctggtgggtgatcttgtcgctcacatggttcctggcggccggtatgaagtggggcaacgaagccatcgccggctactcgcagtacttccacctggccgcgtggcttgtgcccagcgtcaagtccatcgcggtgctggcgctcagctcggtggacggcgacccggtggcgggcatctgctacgtgggcaaccagagcctggacaacctgcgcggcttcgtgctggcgccgctggtcatctacctcttcatcggcaccatgttcctgctggccggcttcgtgtccctcttccgcatccgctcggtcatcaagcaacaggacggccccaccaagacgcacaagctggagaagctgatgatccgcctgggcctgttcaccgtgctctacaccgtgcccgccgcggtggtggtcgcctgcctcttctacgagcagcacaaccgcccgcgctgggaggccacgcacaactgcccgtgcctgcgggacctgcagcccgaccaggcacgcaggcccgactacgccgtcttcatgctcaagtacttcatgtgcctagtggtgggcatcacctcgggcgtgtgggtctggtccggcaagacgctggagtcctggcgctccctgtgcacccgctgctgctgggccagcaagggcgccgcggtgggcgggggcgcgggcgccacggccgcggggggtggcggcgggccggggggcggcggcggcgggggacccggcggcggcggggggccgggcggcggcgggggctccctctacagcgacgtcagcactggcctgacgtggcggtcgggcacggcgagctccgtgtcttatccaaagcagatgccattgtcccaggtctgagcggaggggagggggcgcccaggaggggtggggaggggggcgaggagagccaagtgcagcgaagggacacttgatgggctgaggttcccaccccttcacagtgttgattgctattagcatgataatgaactcttaatggtatccattagctgggacttaaatgactcacttagaacaaagtacctggcattgaagcctcccagacccagccccttttcctccattgatgtgcggggagctcctcccgccacgcgttaatttctgttggctgaggagggtggactctgcggcgtttccagaacccgagatttggagccctccctggctgcacttggctgggtttgcagtcagatacacagatttcacctgggagaacctctttttctccctcgactcttcctacgtaaactcccacccctgacttaccctggaggaggggtgaccgccacctgatgggattgcacggtttgggtattcttaatgaccaggcaaatgccttaagtaaacaaacaagaaatgtcttaattatacaccccacgtaaatacgggtttcttacattagaggatgtatttatataattatttgttaaattgtaaaaaaaaaagtgtaaaatatgtatatatccaaagatatagtgtgtacatttttttgtaaaaagtttagaggcttacccctgtaagaacagatataagtattctattttgtcaataaaatgacttttgataaatgatttaaccattgccctctcccccgcctcttctgagctgtcacctttaaagtgcttgctaaggacgcatggggaaaatggacattttctggcttgtcattctgtacactgaccttaggcatggagaaaattacttgttaaactctagttcttaagttgttagccaagtaaatatcattgttgaactgaaatcaaaattgagtttttgcaccttccccaaagacggtgtttttcatgggagctcttttctgatccatggataacaactctcactttagtggatgtaaatggaacttctgcaaggcagtaattccccttaggccttgttatttatcctgcatggtatcactaaaggtttcaaaaccctg

SEQ ID NO: 7836 - DNA, 2338 bp, Homo sapiens
  ENST00000344575
tggctcagcggcggctccggtggcagcggcggtggcggctaggcgggctcggcggctcctgtccctcgggcggctgcccgctcgctgcccagggcgcccggacacacgtgggcggctcagcgatggcccgcgccccgcgacgtggcgggcaggcaccggggcgcgggaccgctgagcccgagtgagccggggccgcgctcccgccttcggcccgggcctcccgggatggccgtggcgcctctgcggggggcgctgctgctgtggcagctgctggcggcgggcggcgcggcactggagatcggccgcttcgacccggagcgcgggcgcggggctgcgccgtgccaggcggtggagatccccatgtgccgcggcatcggctacaacctgacccgcatgcccaacctgctgggccacacgtcgcagggcgaggcggctgccgagctagcggagttcgcgccgctggtgcagtacggctgccacagccacctgcgcttcttcctgtgctcgctctacgcgcccatgtgcaccgaccaggtctcgacgcccattcccgcctgccggcccatgtgcgagcaggcgcgcctgcgctgcgcgcccatcatggagcagttcaacttcggctggccggactcgctcgactgcgcccggctgcccacgcgcaacgacccgcacgcgctgtgcatggaggcgcccgagaacgccacggccggccccgcggagccccacaagggcctgggcatgctgcccgtggcgccgcggcccgcgcgccctcccggagacctgggcccgggcgcgggcggcagtggcacctgcgagaaccccgagaagttccagtacgtggagaagagccgctcgtgcgcaccgcgctgcgggcccggcgtcgaggtgttctggtcccggcgcgacaaggacttcgcgctggtctggatggccgtgtggtcggcgctgtgcttcttctccaccgccttcactgtgctcaccttcttgctggagccccaccgcttccagtaccccgagcgccccatcatcttcctctccatgtgctacaacgtctactcgctggccttcctgatccgtgcggtggccggagcgcagagcgtggcctgtgaccaggaggcgggcgcgctctacgtgatccaggagggcctggagaacacgggctgcacgctggtcttcctactgctctactacttcggcatggccagctcgctctggtgggtggtcctgacgctcacctggttcctggctgccgggaagaaatggggccacgaggccatcgaggcccacggcagctatttccacatggctgcctggggcctgcccgcgctcaagaccatcgtcatcctgaccctgcgcaaggtggcgggtgatgagctgactgggctttgctacgtggccagcacggatgcagcagcgctcacgggcttcgtgctggtgcccctctctggctacctggtgctgggcagtagtttcctcctgaccggcttcgtggccctcttccacatccgcaagatcatgaagacgggcggcaccaacacagagaagctggagaagctcatggtcaagatcggggtcttctccatcctctacacggtgcccgccacctgcgtcatcgtttgctatgtctacgaacgcctcaacatggacttctggcgccttcgggccacagagcagccatgcgcagcggccgcggggcccggaggccggagggactgctcgctgccagggggctcggtgcccaccgtggcggtcttcatgctcaaaattttcatgtcactggtggtggggatcaccagcggcgtctgggtgtggagctccaagactttccagacctggcagagcctgtgctaccgcaagatagcagctggccgggcccgggccaaggcctgccgcgcccccgggagctacggacgtggcacgcactgccactataaggctcccaccgtggtcttgcacatgactaagacggacccctctttggagaaccccacacacctctagccacacaggcctggcgcggggtggctgctgccccctccttgccctccacgccctgccccctgcatcccctagagacagctgactagcagctgcccagctgtcaaggtcaggcaagtgagcaccggggactgaggatcagggcgggaccccgtgaggctcattaggggagatgggggtctcccctaatgcgggggctggaccaggctgagtccccacagggtcctagtggaggatgtggaggggcggggcagaggggtccagccggagtttatttaatgatgtaatttattgttgcgttcctctggaagctgtgactggaataaacccccgcgtggca

SEQ ID NO: 7837 - DNA, 5212 bp, Homo sapiens
  ENST00000441788
ggccgggcgcgcgcggcggagggagggagccgggaggcagcggaggagcgaccgccgccatattagggaccgcggagcccgggatcccgtcagcggcggccgcggccgggcctgcgggagctgcggaggccggaggcgggcgctgtgcggtgccaggagaggcggggtcggcgggagccagcgagccacgggagcgagccaggctaaccttgccgcgggccgagccctgcctcgccatggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacgtattcccttagcaccaagcgctccagccccgatgacggcaacgatgtgtctccctactccctgtctcccgtcagcaacaagagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaaacctgccgggcaggaccgtgccacaccagctgtccagagtcggaggaccccagctcctcagcttgcatggactctgccttcccagcgcttgtcccccgaggaaggcggctgggcgggcggggagctgggcctggaggatcctggagtctcattaaatgcctgattgtgaaccatgtccaccagtatctggggtgggcacgtggtcggggaccctcagcagcaggggctctgtctcccttcccaaagggcgagaaccacattggacggtcccggctcagaccgtctgtactcagagcgacggatgccccctgggaccctcactgcctccgtctgttcatcacctgcccaccggagccgcatgctcttcctggaactgcccacgtctgcacagaacagaccaccagacgccagggctgattggtgggggcctgagaccccggttgcccattcatggctgcaccccaccatgtcaaacccaagaccagccccaaggccagaccaaggcatgtaggcctgggcaggtggctcggggccactggcggagccagcctgtggatccaagagacagtccccacctgggcttcacggcatccttgcagccacctctgctgtcactgctcgaagcagcagtctctctggaagcatctgtgtcatggccatcgcccggcggtcagtgggcttcagatgggcctgtgcatcctggccaagcgtcaccctcacactggaggaggatgtctgctctggacttatcaccccaggagaactgaacccggacctgctcactgccctggctggagaggagcacaacagatgccacgtcttcgtgcattcgccaacacgtgccctcacagggccagcgtcctccttccctgcgcaagacttgcgtcccccatgcctgctgggtggctgggtcctgtggaggccagcagcggtgtggcccccgcccccaggctgcctgtgtcttcacctgtcctgtccaccagcgccaacagccgtggggaagccaaggagacccaaggggtccaggaggtgggcgccctccatccttcgagaagcttcccaggctcctctgcttctctgtctcatgctcccaggctgcacagcaggcagggagggaggcaaggcaggggagtggggcctgagctgagcactgccccctcacccccccaccaccccttcccatttcatcggtggggacgtggagagggtggggcgggctggggttggagggtcccacccaccaccctgctgtgcttgggaacccccactccccactccccacatcccaacatcctggtgtctgtccccagtggggttggcgtgcatgtgtacatatgtatttgtgacttttctttggatttgttttgtgtttttgttgactagtcctggaaatgtttgaggctagacggggaggggccaggacccacccactgctcctgggggatgaggtcctggttttaaagccccgtcatttcaagcgggtcgatcttccacattcactggagagactctccccacctctgtctgggtggggcgcggacccctcactgtgcgcctgtgcagggggtgctggtgcacgtggcagtgtggatttccagtggtcacggtcttactgtttcaaggtttttaaataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcagggccaggcggacggcgtgaggtttgtgttggggctggttctgcccatgctagggggtgggggagctcccaggacagaccagccttgtttctcatgtaatgcagtgacgctgtcattaaacacgtggattcatgtgtggccgggactggctggctctaggtccccggctcgggtggggtcacacggtcctgccctagagtccccatctggccctggagctgcagaagcagcttctgaggggcttcccaggcctgcatttcacagatggggagctcagccctcgaaggccgcagagacgcctcccaggcccgtctgccagggcgccggccacaatcctgcagggccaaggactggactccaggcaagtccctgcgctccagctggacggccctgttccagggaggaggtgctcggttgacaccatcagggagggagggtgggcactgctgggctgagttcacccccagggctggccagatggggccaggagggacagagcaaggggggtgaaggccgtggtgggagggtcccatgatgatgggccagggctcgtgtagaaatgggggaattggttccccatggcccaggacagctgagaggaggtggaggggccccaggggagtgtacgtcaggctttgcggggcacgggggccactcagcagcgctggggcaggtgcctctgctgtcagctccacccgacaggcagacgaaggccagtggggccatcgcttcctggggcgaccctggcagtggttgggagacgcccagatggagggggaggctgaccaagggccccgcagggcgggctgcaacttttctgttgatcctggaatgtagctggtgcagtgagagggaaagagaattgaaaaactcaggctgccataggttctgcgatgagaggtgcaggaggcaggagcctggcccagggggtgctggtgcctccccggggtctgggcggagagaacaggaggaatggctgggaagtggctgagggagccaggaggccggggggccgggggctgcaggggaggctgtgggggtcctggcagccaggaggccccaggtggttttgaggctcgctcttgcgcggtgcctgagaagagggtgaaggagctggggcaggccccatcctgggcattggagatgatgaaaccgagcagacctggcccatgtggagctggcatgggggacacagcccagagacagagaagcttatgaggaagtgaggaggtggcgtcacaagggtggggagggggccttggggaagggcggccttggatcagaggctcaccacaagcctggcatttcagccagggctggagaaggcagggacgcctgggtgagaggcaaagggcacagccatgcaaaggccctggggcaggacggcacctggtatgcgggaggaacagagtgaggagaggagggcagggcgtgcagggccttgtgggcctcagggaggacttgggcacctacgccgagggagtggagctcctgggtgcgtgtccagatgggaaaggcagggtcgtatctgtggggacctgacaagggcaggggaagcggagaccagggtgcaggctccgcccccacccaaggccgggcccagccagaggaggggcagggcagggcaggaggtttctggatgtttgttgggtttggtttggttttgttttgttttgtttattgtggtaaaatacaaaatctaccgtcttaca

SEQ ID NO: 7838 - DNA, 675 bp, Homo sapiens
  ENST00000588327
gccgggcctgcgggagctgcggaggccggaggcgggcgctgtgcggtgccaggagaggcggggtcggcgggagccagcgagccacgggagcgagccaggctaaccttgccgcgggccgagccctgcctcgccatggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaaggttagggtcccagcccatccgccctgcaggcccccaccctgccttgccccgcctcactgtgcttggtgcccgcagacggcctggcctactctgccctgctcaagaatgagctgctgggtgccggcatcgagaaggtgcaggacccgcagactgaggaccgcaggctgcagccctccacgcctgagaagaagggtctgttcacgtattcccttagcaccaagcgctccagccccgatgacggcaacgatgtgtctccctactccctgtctcccgtcagcaacaag

SEQ ID NO: 7839 - DNA, 1331 bp, Homo sapiens
  ENST00000591290
ctcgccatggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacgtattcccttagcaccaagcgctccagccccgatgacggcaacgatgtgtctccctactccctgtctcccgtcagcaacaagagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaaacc

SEQ ID NO: 7840 - DNA, 1491 bp, Homo sapiens
  ENST00000395095
atggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacgtattcccttagcaccaagcgctccagccccgatgacggcaacgatgtgtctccctactccctgtctcccgtcagcaacaagagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggtaaagtgggagtctgtgtctgtgctcaacctcttcaccaggatccggtaa

SEQ ID NO: 7841 - DNA, 1215 bp, Homo sapiens
  ENST00000313639
atggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaa

SEQ ID NO: 7842 - DNA, 598 bp, Homo sapiens
  ENST00000592214
ctctgctctcctgcctgcaggagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacgtattcccttagcaccaagcgctccagccccgatgacggcaacgatgtgtctccctactccctgtctcccgtcagcaacaagagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgacgcggctctgtgacctctcagtggaaggggactcagtgacctccgtgggctggtctgagcgggggaacctggtggcggtgggcacacacaagggcttcgtgcagatctgggacgc

SEQ ID NO: 7843 - DNA, 623 bp, Homo sapiens
  ENST00000586212
aaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggtgagttcacgccaggcacttcaaggtgccccgggattctggacaaactgccatggccaccccagagcaccctgtcctgtgttcttagggaggatggtgtgcagatctaaaaccccgtgggacccagcagcaggggccggcagggcatctggtgctggttgtgttgccagcgttggaatgggctctaccgaactccccagccctgcaggtgcaggccctgtcctcctggaggaccttagcttcttcatttgtttattttccccataaagaggggtgaagaggaaagccaaaaccaactcacagctgaccactcagatgaccctgtgaacgtcctacacagtaactgtatg

SEQ ID NO: 7844 - DNA, 671 bp, Homo sapiens
  ENST00000588084
ctgcccctccctcctggctccagagtctggggggcccagccacccgacaccttgctcccctctccttcagtcccccagcactgtcccgaggcacctagaggcccagagacatggggtgcttccctcctgtccacaggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaaacctgccgggcaggaccgtgccacaccagctgtccagagtcggaggaccccagctcctcagcttgcatggactctgccttcccagcgcttgtcccccgaggaaggcggctgggcgggcggggagctgggcctggaggatcctggagtctcattaaatgcctgattgtgaaccatgtccaccagtatctggggtgggcacgtggtcggggaccctcagcagcaggggctctgtctcccttcccaaagggcgagaaccacattggacggtcccggctcagaccgtctgtactcagagcgacggatgccccctgggaccctcactgcctccgtctgttcatcacctgcccaccggagccgcatgctcttcctggaactgcccacgtctgcacagaacagacca

SEQ ID NO: 7845 - DNA, 7981 bp, Homo sapiens
  ENST00000262995
gtgtgtgtgtgtgtgtgtgagcagcgctgtgtctgtttcggaaagcgctctggggaggtcttgtccctagggggcggagcgcaaaggacagaagctccggcaccgagtcggggcagagtcccgctgagtccgagcgctgctgaggcagctggcgagacggcacgtctggaggcgaggcgggcgcactgaaaggaggccggcgcgcccgcggccccggctcgcgttctgttcaggttcgtgggcctgcagaggagagactcgaactcgtggaacccgcgcaccgtggagtctgtccgcccagtccgtccggggtgcgcgaccaggagagctaggttctcgccactgcgcgctcggcaggcgtcggctgtgtcgggagcgcgcccgccgcccctcagctgcccggcccggagcccgagacgcgcgcaccatgagcggtggtgaagtggtctgctccggatggctccgcaagtcccccccggagaaaaagttgaagcgttatgcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaaggtcaaagtcctaaaattttaagactcaaaccccatggtttagagcgaactgattcacaaaccataggtgactttgctacaagaagaaaggtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataacaatactaagtcaactaagctacttttagatttggaaattgctgtttacagtctaacaacattaaaatgagaggtagattcacaagttagctttctacctgaagcttcaggtgataaccattagcttatacttggactcatcatttgttgccttccaaaatgctgaggataatgtatgtactggtgtcaggacctagttctctggttaatgtacatttagtttttaatggtggaactttgttatattttgttaattacagtgtttttggttcattgagtgaagattctgccgggtgggatcttgcacctttgaaagactgaataattacactaccaagtaagcctgcaaatcattgatggcatgcagtgatgatgtgctcttacacttgttaacatgtattaagtgttatttgcaaaaggtagattatgtaaccaatcaggtacgtaccaggcagtgatgtgctaatacactgatcaggtttagacaatgagctttggttgtgttcttgttagtcctaatattggttttcagtttggaattaataaagcagttgacattcactgttagttacagcaacatactgtgatttttaattagatagtaattcagatttattactctatgaaattctgtcttttgacaccatagtgccctttctatgattttttttacttaatattcttcttggccttatatttaattccctatgcaattaatattttatatctgcatttttttaaaaaaaatagatgttatataagtgattctcgtatgtagcacctgttgcttttccactgaaagaattacggattttgtactgtgatttatattcactgccccaattcaagaaatattggagccttgctacaatgtgaaatgttatagtcatggactccttccaaccagatttctgaaaacaccagagggatggtataattctgtctcacctataacatggtcctgtgacatagatattaagaccacaagttgtagtgaggctacaattatattcgtctgtcttggctttgcaacataatttagaaagcacgtatagttgttttttaaccaagttacatacaatctcatgtactgatttgagacttataacaatttttggagggggcatagagaaaggagtgcccacagttgaggcatgaccccctccattcagacctctaactgttgcctgagtacacagatgtgccctgatttctggcccattggccatagtactgtgcctaatcaatgtaataggtttattttcccaatcctcaaactaaaaatgttcataacaagatgaattgtagactagtaacatttgatgcttttaaatatttgcttctttttaaacaaaaactaaaacccagaagtgaatttttaggtggatttttaaataaaaaagattgattgagtttggtgtgcaagctgttttataatgaaacaacaaaatgaaatctaaaatcctgaaatgtgcctaaactatcaaaacacacgatacagctaatgtgtaaagatgctaaattctgttacttggaggatgaatatatttaagatttaaaacacaataataaatacatgattaattcaaaaataaaaatctttacagctgcctatcaagggtctaaagcacttaatgaatgtttttagtctaacttatcattaactttttacaagtcaccatatttgaagatctgtagcactctgattttcagaaaatttttcattctgaataatttaaaaatggtgatgtattagaaaggcagtttgctttagaaaactaaatcacattgaacattgtattagagaattaaattaaaagtttcttacagagcagtattttccaaacatttttagcactagaatctttttagatgaaattttatgtataaccccaatacataaagcctgaaaactcaattttatcaatataaatgtattttgggttcacatttatgcttattcattttggctcattactaagcataataagattctgagttatttctgaataacacaaatgtggagttatacatagttgatgaaaccagcagccaatttatagctatgccctgttttatttgtatactatcaagaaaattttgattcacacaaatgtaagcaaaaataataggttttaaacatacatctcaggaaattctttaattagagatagctaaagttattcaaggtctatacaaaaataagttatcctggtagtggaagttaatacataagcagtctccagtgtggtaaagtagggtatgtaacacatcagaatgtgcgtttttattaggttttaaaatatgcacgtataaaaactaaatttgaatcaaacccttttaactcacctccaagaagctagactttggccaggaatgggctaaaaaccactggttaacgatgtgacagttatgatcttggagattggaaatctttcttccacattagagttctttaccttaattccttattctgaaaaattgtaagattttatgaaggtttgaatactgaagcacagttctgctttcaaaaattaaaattcaaacttgaaaaagctgtttaacccatggaagatatcatttagtaagatgtaaaagattttttaaatctacacttcagtttatacatctttatcattatcaatactatataagttactgtgagcattttagagaattccataaaggtactatgagtgtgtctgtatgtgtgtgtatatatagcattgtatttaatcatagactaaatttaatttgatatagaaatactactttacttgtacattaaggtcataatttctgctggactcttttatatttaattaatggggattatagtcttccttcataaatgcatttaaacctgaaattgaacaccagtgtttttctttttctacttatgggaagttgtctgcttccccctttagagaaaacagtatttttatattttgttaaaatattaactactttatgcctacacactatgctgtagatactgatcataattcttgggtgttcacaaacactcctagtgcctcttttttggcccgttgaaagtgttggtattactactttcactacagagcctttggccctctaataatgctgaggtgggctgatccttcccatttctgtcttcgggtcattctggtaggtcttctcctccactgtcaagtaagcaatcaggtccgtgacagggattggacatatgaacaaattaagtggatacacacagtgagaaagatacatgcattctatggtaacaactactgtcaataacatctgatgttacatgcacatttatatatatataattttaaaaactgaactatgagaagccatggtataaatgaatattgtggacatcatggacttgatatgatagaaatcaattgtcagcttgagaaagttgtttttaatctgtctaaatagttcatgcattactacagttaaaaatagtttcatttgtcttctatagacttaattttattccggttcagtataatctctgttaacagagtttcagcaaactgattggtcaaggtattaacatagcttctacttcctttacttaaaaagatgtggttttatgtaagttcttgattactgatgatcatcccaaattttgacaacaaaatcatatgtataaatttatttctcccctcttgttcatcatcttttgtaaaggtcccattgtagatcttttctgctaccaaataaaacttttcaaacaatttggtttcaagaccttaaatagacaagttggatactaagattgtgaactgataaggacatataaatttatatttccagcccttccttagagtctttatctgcatcaaaaacccaattctgccattaactgtgcttcccagtcccacctctatatgtcactcattttctgcaacaaagatctcactaaatcatgttgaaacacaagtcatgatcctctctaagtaaatagaaaaagctccctggaaaaactctgttgccacatgcacgtgccctgttactcctccagccagccagtgctgccagcattttattgtgtaaaagtccaaataaataagggcctgcatgcaacctttatcttcagaaactaggttttatatgtaaaatgtgacttgggaaatgattctgtttattaactggctgggatttttcatttctatgaaagtttcaaacatctccagtactttataaaatcccaacaattgctgtaagtcagcactttggtccactcagcccacccagcccacttgcaactctgactcttcactgaatcatatttgggaagtttgggtagggtgaggctatcttcttcaagattattttctcatatgtctgtctgtcaccttgtaaaccatgagactcctgggtatttgcatgtaacttctttgaggaagttaccaccatctctgatatagacacactttttgagttgcagtttctgttagaattttttggagactaacttgccaattctgtgaatgttattgaatatttaaaaagctgggtctgtaatgggaggcattttattagctgttgtgattgggtaacatgtccccttagatttcctgatttaaaattatacaaaattactatttttgataaaataaaggaacacctacagaaaattaagtttctaagatgtttctatacttcattagaaaagattttattactattacttatggttattggtgattaacacttaatgcgtctcctctgattttgtgttccatgaggtgcttggaacatttggagtgctctgtgcgagggacatacagtgatataggaaatttaaaaattaaaataatacccaaaacccactttatcagatatggtattgtgatggttaatattatgtgtcaacttggtgaggctatggcgcccatgtgtttggtcaaacactagcctagatgttgctgtgaatatattttgtagatgtgattaacatttacaatcagttgattttaagtaaagcagattctcatccataa

SEQ ID NO: 7846 - DNA, 2648 bp, Homo sapiens
  ENST00000262994
gagtccgagcgctgctgaggcagctggcgagacggcacgtctggaggcgaggcgggcgcactgaaaggaggccggcgcgcccgcggccccggctcgcgttctgttcaggttcgtgggcctgcagaggagagactcgaactcgtggaacccgcgcaccgtggagtctgtccgcccagtccgtccggggtgcgcgaccaggagagctaggttctcgccactgcgcgctcggcaggcgtcggctgtgtcgggagcgcgcccgccgcccctcagctgcccggcccggagcccgagacgcgcgcaccatgagcggtggtgaagtggtctgctccggatggctccgcaagtcccccccggagaaaaagttgaagcgttatgcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaagtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcg

SEQ ID NO: 7847 - DNA, 728 bp, Homo sapiens
  ENST00000514639
acgcgcgcaccatgagcggtggtgaagtggtctgctccggatggctccgcaagtcccccccggagaaaaagttgaagcgttatgcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagccaagggtcatcttttgtttctgaagaaggagaggaataccttctactagaagattttgaaagcaaaacgattccattgcaaacgcatgctgattctgcaaaatccacctcttctgaaacagac

SEQ ID NO: 7848 - DNA, 582 bp, Homo sapiens
  ENST00000515366
aaaaattatagaggatctgcagactgagacgcattgggactgaaattaggcaattcagagtttctcatgcatagtctcactgtgttgcccagattggtcttgaactcctggcctcaagtgatcctctttccttgccctcccaaagtgctgggattacaggcttgagccaccactcccagccaacagaattcttttcaacagcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcag

SEQ ID NO: 7849 - DNA, 2477 bp, Homo sapiens
  ENST00000505913
attactttcctagactctagtcatgaacaggatgttggaagtcagaggtacagagaagctgcctttttaggccgctcacatgaaaggcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaagtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataaca

SEQ ID NO: 7850 - DNA, 1176 bp, Homo sapiens
  ENST00000515388
actttcctagactctagtcatgaacaggatgttggaagtcagaggtacagagaagctgcctttttaggccgctcacatgaaagccagccatctgggcaacaagaaaggcttactacagttagataaatttaaccccttctctgacctggcaaggacaaagtacactggcttctgaagaaactttttcttgggagcaaggtagttatttcaaagcacagaaaaaggcggcggggggcacagagaagcacagagaagcgggggcagttgcacaggttgtttattctgttgatggatattggactggagtgatgagtgttctaggatgggtatttgatgatgccaggggactcaagtaatggctttgcatgaagattacacagtaaagctgcacattgattacctcatcttattagctgatggagatgtttgagaggacaagattgcagggctttcaagcctgtacagctaccaggatttgatcctaagagcttgatcattgtcattgcccatagggactgtgttaagaatagtggtggtttactacttaaacgcatgagagtgttataacagttccctatgtcttttgaattgtttagataaggttaggactttcagatcaacttgagttttaatttttagcatttatagaattctaaaattaatcctgtttgtttttgtcttcctccactaaaatttaagtttgctgaggtagacagttttgtttctggaaccactatccctccagcggctagaacagtggaacatgttcaataaatattcaataaatatttttgaataagtgaatgaatgaacaggttaaatgtaatctttattttttaatgaactatcctttccagagacatacaaattgccagttgatggcattttttatttctttttgtaaaaagagtattttaaaatttgaatgagttctatctaacagataacacagttgagtacattaaaagggaccttgaacacaaaatccatgttttcgtggattagtatttttgcagcttaaatggtgaacgataggattgttagatgcaaataactctggaaattaaagacctttagttgtaactctccctaaaatgtttgtgagagcttgtaaaatgttgttcactttattctattataaaagggcattataataaatatgaagttttgaaacca

SEQ ID NO: 7851 - DNA, 743 bp, Homo sapiens
  ENST00000509992
caaggacaaagtacactggcttctgaagaaactttttcttgggagcaaggacttgggggtaacaaaatgaggagtaagtgaagaaagaagaaggcacagcttgtcgagattgatggaccgccccccgcccccgggagagcagcgtaggaaattgcaggatgaaatttgtgtgccagtcttgtcagcacccattcctgttgaaggagagggcatatggatgaggcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccag

SEQ ID NO: 7852 - DNA, 571 bp, Homo sapiens
  ENST00000511836
tggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaaggatctcactttgtcgtctaggctggagtacagtggcatgatctctgctcactgcaacctctgcctcccaggttcaagcgattctcgtgcctcagccttctgagtagctggaattacagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgct

SEQ ID NO: 7853 - DNA, 470 bp, Homo sapiens
  ENST00000512843
atcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattg

SEQ ID NO: 7854 - DNA, 559 bp, Homo sapiens
  ENST00000507334
ctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttgtaagtataattgaccttggcatcatcaagtgtatttcattgtctaaatcttcataattagtgccatgagactaagtgatatcatgaaataaaagtacgctgagatccatatgaatgagtgtgacttac

SEQ ID NO: 7855 - DNA, 677 bp, Homo sapiens
  ENST00000507070
agacacagttctatgagcatcctttttaaaattctgtgtgtgtgcatgtgtgtatgcatatgtataatgagagaaagataataggtcatcccaatgaccctgagagctggcaaagatgggaataaatgttgatagtttgttctttattttagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaaggtcaaagtcctaaaattttaagactcaaaccccatggtttagagcgaactgattcacaaaccataggtgactttgctacaagaagaaaggtcaagccagcgcctttagaaataaaacctttgccagaatgggaag

SEQ ID NO: 7856 - DNA, 568 bp, Homo sapiens
  ENST00000510615
ttttaaaattctgtgtgtgtgcatgtgtgtatgcatatgtataatgagagaaagataataggtcatcccaatgaccctgagagctggcaaagatgggaataaatgttgatagtttgttctttattttagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaagtcaagccagcgcctttagaaataaaacctttgccagaatgggaagaatt

SEQ ID NO: 7857 - DNA, 577 bp, Homo sapiens
  ENST00000508833
attccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaaggtcaaagtcctaaaattttaagactcaaaccccatggtttagagcgaactgattcacaaaccataggtgactttgctacaagaagaaaggtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccataacagtcttgatggaggaagcagccctatgatcaagcccaaaggagacaaacaggtgg

SEQ ID NO: 7858 - DNA, 838 bp, Homo sapiens
  ENST00000511109
tatgtcctcttgaaagcaaatatttaggcttccgtagatgttcaacagtacgagtggtatgtctggtgaatgtctgaccgttgattttgttgtctaatactttcagaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataacaatactaagtcaactaagctacttttagatttggaaattgctgtttacagtctaacaacattaaaatgagagg

SEQ ID NO: 7859 - DNA, 6052 bp, Homo sapiens
  ENST00000340149
gaaattttgagaagtggtgggatgaagaagatccctgaagagaggagtaactgagacaaaggcgaggctagcaatagagagacaagtgagggaattagacctttggtatcatcatgaaaaggcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtgatgagagggccaccgcagagcccaggaggcagcatctccagagctggcccttcccatctcccctctcccctctcccgttcttcctcccatccacctcctctctactctgccagtctcagccttcaaagcacttgacatcagggaccctgaacccttcccctgggaggtgagggcctgatcaaggcacctcctctgcccactcggggcccagctgtgatttttatcagtaatggccatgcctccacccaccttagttaggagctacttccaaaaagcatccttcagcctcttcctgtcctttagacctgactctctaccagatgtttggagggaagggctggggctctgagccagattccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaggacaaaaggaagggaaaactgatggccaacctagagcagcaaggagcagggcttggagctcgggtggtggagatgacaaggacactgtggggtctgggtccccagaactctggagctacaggccactctaggcccaagggctagtcctcttccccagtcccctcagaggcccccgccagccccaccttgaaagcagcatacaggggaaggcttggaccaagctgggcgaccaagcacatggggcaggaacacatggtaaaggggtggggaatatgggagggagtgtggtgtggatgggggtgatgcagggactgaggggaaccctgggacaggcacaggctgggcagaggcacagggcagtgcaggggactctgcagtggggtcgggaagtgagtttctttgcagtgagcagtgcagtggaagtcgggcacagaggtagcagacagatgtgaagcagtggtgaaggccatgtagcaagtggggaaatacatccaaagggcctgggagttggggggtgcccaacgcaatccttgggggtgcagggtggagcagaaagtgaaggagggacacgtgcaagagtggtgtgcatggtggtgtgacatgaggaccgttcctaggatgggacagtgggtcaggcaggacaaggagaaagcagggcagaatgatgcctagaggaccacatcaggcatggctgacagcttgtgcccatgggctgtggcgtatgtcagatcgcagggtaggaacgagtctggcctggtgccggcccagtgtttcctcagctcatccgccctctgttgctccctagcattccaggagccatcttggactctcctccccaggtttgaaaggccatcagattagcagggacggggtgtagggcatcacccaaggttccttctcttaaactaagggtgggggatctgaatgtttttatgttgactgttcttgactaaattttcaagagtttcagaagcaacaggacagaccagacgtttcattctaccctggggcgaacagaacttcttcctcccaaacaatgacttcctgccatgtttgatggggacagctaccactgtcctctgcccccattcccctttcagctcccatgagcatgcatagttcaccagaccaatggcctagccattctctaagtcccatcctggaagaagttatttcttcaagagctgcacctctcctcctagcattagtttagatcaactcaaggagtatttattaatggctgctgtctccagtttctggggttaagcactaaggacacaagaatcaatcagaccttctccctgaacttaagatagccacaatcagaaaaaggacaaggacatgagacagtggtgatggccatcagacagagacttcaaatgctgatggagggcagaggaagtacttagggaggttggtgtcagaggcaggagtgggggatcagggaaggtggattctaggaaaagggagtgcctgaggtaggccttagaaggggatgagtcagatttttacagaggaggagggcagggcttgggtccagtggaggaagaaggaaggagaggcttggaaagccttgtgtcttgggaacaaaaggcctttgagcatatgggtccagccactcagaagtgtaggggccatgccttggtgttccaataagtgaatggaagcagtggtggtagctacactgggcagagttggcagggtgctggttcactctgcccagccctgaatgtgtgccttaaaggccccctacaaggggccccatacgacagagcttttaactggtgccttccctgtacccgcagcagccacaagtgggcccagactattgcagcctcccataaacatgtgagcatgttctgagtgtgccatgatgtgagtggacctggctggaatcttcggagagcgactgaggtgttcaaatcgaatctcccaggaggcttccttccagccccctattctggtaactaccaggaggcttccttccagccccctattctggtaactaccaaaatccctcgggtgcaagtgtaggggtagagatggaaggatgagaggtgaaattgaccttttgaaagcaaagctctggctcacaggccccaaactaccagccgtatctagcatatccccaccctccacccactacctcctccaacaaaggagtcaactcagttgaaaaaactggtcctttggcctatccatgggtcaaagtccacctctcctgggggcctggagaggactgagcctacggaaaggggataccttcccactcagcactgcttcacacaggccccctgcctggggctctccaaggagccttcttcacccacttccagctccacttctgcaaggttaagtcaagtgagaacgatgagaaatagggagatggtgtctccttaagtccttgatctgcctgtctgtggaatgggaggttggattagctgcgctgaggtcccatccacagctggtgctcagctgcttgaaggggagactccctcctctgtaacttctttctgggggattggggtgggcagtacctatccccagtcccctcctagcttgactttagtggtttccaatgtagaagttaacaaagtatgccccattcctgtgacaaaagcacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaaatgcacccc

SEQ ID NO: 7860 - DNA, 6092 bp, Homo sapiens
  ENST00000361507
gagctgcgcaccgccggccgctgccccagctgcccgagcccgcgccctcgtccgcgcgacccggcggggggctccaggccggcagcatgagcggcggcggcgacgtggtgtgcaccggctggctgaggaaatcgcctcccgagaagaagttgaggcgctatgcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtgatgagagggccaccgcagagcccaggaggcagcatctccagagctggcccttcccatctcccctctcccctctcccgttcttcctcccatccacctcctctctactctgccagtctcagccttcaaagcacttgacatcagggaccctgaacccttcccctgggaggtgagggcctgatcaaggcacctcctctgcccactcggggcccagctgtgatttttatcagtaatggccatgcctccacccaccttagttaggagctacttccaaaaagcatccttcagcctcttcctgtcctttagacctgactctctaccagatgtttggagggaagggctggggctctgagccagattccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaggacaaaaggaagggaaaactgatggccaacctagagcagcaaggagcagggcttggagctcgggtggtggagatgacaaggacactgtggggtctgggtccccagaactctggagctacaggccactctaggcccaagggctagtcctcttccccagtcccctcagaggcccccgccagccccaccttgaaagcagcatacaggggaaggcttggaccaagctgggcgaccaagcacatggggcaggaacacatggtaaaggggtggggaatatgggagggagtgtggtgtggatgggggtgatgcagggactgaggggaaccctgggacaggcacaggctgggcagaggcacagggcagtgcaggggactctgcagtggggtcgggaagtgagtttctttgcagtgagcagtgcagtggaagtcgggcacagaggtagcagacagatgtgaagcagtggtgaaggccatgtagcaagtggggaaatacatccaaagggcctgggagttggggggtgcccaacgcaatccttgggggtgcagggtggagcagaaagtgaaggagggacacgtgcaagagtggtgtgcatggtggtgtgacatgaggaccgttcctaggatgggacagtgggtcaggcaggacaaggagaaagcagggcagaatgatgcctagaggaccacatcaggcatggctgacagcttgtgcccatgggctgtggcgtatgtcagatcgcagggtaggaacgagtctggcctggtgccggcccagtgtttcctcagctcatccgccctctgttgctccctagcattccaggagccatcttggactctcctccccaggtttgaaaggccatcagattagcagggacggggtgtagggcatcacccaaggttccttctcttaaactaagggtgggggatctgaatgtttttatgttgactgttcttgactaaattttcaagagtttcagaagcaacaggacagaccagacgtttcattctaccctggggcgaacagaacttcttcctcccaaacaatgacttcctgccatgtttgatggggacagctaccactgtcctctgcccccattcccctttcagctcccatgagcatgcatagttcaccagaccaatggcctagccattctctaagtcccatcctggaagaagttatttcttcaagagctgcacctctcctcctagcattagtttagatcaactcaaggagtatttattaatggctgctgtctccagtttctggggttaagcactaaggacacaagaatcaatcagaccttctccctgaacttaagatagccacaatcagaaaaaggacaaggacatgagacagtggtgatggccatcagacagagacttcaaatgctgatggagggcagaggaagtacttagggaggttggtgtcagaggcaggagtgggggatcagggaaggtggattctaggaaaagggagtgcctgaggtaggccttagaaggggatgagtcagatttttacagaggaggagggcagggcttgggtccagtggaggaagaaggaaggagaggcttggaaagccttgtgtcttgggaacaaaaggcctttgagcatatgggtccagccactcagaagtgtaggggccatgccttggtgttccaataagtgaatggaagcagtggtggtagctacactgggcagagttggcagggtgctggttcactctgcccagccctgaatgtgtgccttaaaggccccctacaaggggccccatacgacagagcttttaactggtgccttccctgtacccgcagcagccacaagtgggcccagactattgcagcctcccataaacatgtgagcatgttctgagtgtgccatgatgtgagtggacctggctggaatcttcggagagcgactgaggtgttcaaatcgaatctcccaggaggcttccttccagccccctattctggtaactaccaggaggcttccttccagccccctattctggtaactaccaaaatccctcgggtgcaagtgtaggggtagagatggaaggatgagaggtgaaattgaccttttgaaagcaaagctctggctcacaggccccaaactaccagccgtatctagcatatccccaccctccacccactacctcctccaacaaaggagtcaactcagttgaaaaaactggtcctttggcctatccatgggtcaaagtccacctctcctgggggcctggagaggactgagcctacggaaaggggataccttcccactcagcactgcttcacacaggccccctgcctggggctctccaaggagccttcttcacccacttccagctccacttctgcaaggttaagtcaagtgagaacgatgagaaatagggagatggtgtctccttaagtccttgatctgcctgtctgtggaatgggaggttggattagctgcgctgaggtcccatccacagctggtgctcagctgcttgaaggggagactccctcctctgtaacttctttctgggggattggggtgggcagtacctatccccagtcccctcctagcttgactttagtggtttccaatgtagaagttaacaaagtatgccccattcctgtgacaaaagcacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaaatgcacccc

SEQ ID NO: 7861 - DNA, 556 bp, Homo sapiens
  ENST00000528329
tagttcaaatgacctcttaaacatggccagtgacagttacagaactctaaatggtgtttaatctacttacaagcattttatattaagtcacccttaaatgggaacatactcattgaaaatcaaagagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcc

SEQ ID NO: 7862 - DNA, 650 bp, Homo sapiens
  ENST00000526030
gcccctggcctcccgcgagctgcgcaccgccggccgctgccccagctgcccgagcccgcgccctcgtccgcgcgacccggcggggggctccaggccggcagcatgagcggcggcggcgacgtggtgtgcaccggctggctgaggaaatcgcctcccgagaagaagttgaggcgctatattcactcctgatccctcatctccctcctcaaaaagaagtctccctcaattatcaactctctgatggattttccctggcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacaggagtgccagcttctctcagggcaccagagcctcttttctcatgaggagtgacacagctgtacaaaaacttgcccagggcaatggacactgtgtca

SEQ ID NO: 7863 - DNA, 543 bp, Homo sapiens
  ENST00000528886
gtagtaggtccgtctcctcctcccgccgagggacgccagagttaaggagcttcttgctgggaaggggtccctcctttcagccggaacctgacccgcagaatgtatcggaaatgcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactct

SEQ ID NO: 7864 - DNA, 567 bp, Homo sapiens
  ENST00000530915
agctgcccgagcccgcgccctcgtccgcgcgacccggcggggggctccaggccggcagcatgagcggcggcggcgacgtggtgtgcaccggctggctgaggaaatcgcctcccgagaagaagttgaggcgctattaccttctgtctgacttcaaccccacatctgcttgacaagaattaactcaaatatctcttcttaacacctacctgattctggcatacagcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctct

SEQ ID NO: 7865 - DNA, 568 bp, Homo sapiens
  ENST00000534823
gagcccgcgccctcgtccgcgcgacccggcggggggctccaggccggcagcatgagcggcggcggcgacgtggtgtgcaccggctggctgaggaaatcgcctcccgagaagaagttgaggcgctatgcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacaggtatgagaacgcacacagatctttctcatagggggttgaggtgaggcccttggattcctggagcattgagagcaggctctagctaaggtttcctgttggaagagcgttcatagataaagggtaaagagtgtgaaggggttg

SEQ ID NO: 7866 - DNA, 760 bp, Homo sapiens
  ENST00000539408
ggggcagcggaacgcgcagagggcacggtgcaagcacgggacagctctgcattggccaaagggatcccaggaggcctggccctcttttctcctgaggctggatcccaaccagcaggaaaaggctggattttcgccttttgtatttgttttggggcccaaccaagaaaaacagtggagggggaataaaacatgtttaaatcttttttttgtcttaaaaccatctttaatttcacagtcacaaaataaaacataactcgaatgttttgatgtttgcagtgacatcgattgtgaaaaaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgctccggggcttgtgtggggacagccagcctcctcgtgttgatttctgatcacctggtacctggtcgcgataaggcaggactgagacgttttttctccgttttggacaccggcttaagtagttaaaactaccgcaggcagctgcgcagccgaattggagggcagaatatggcttaagtggtagggggac

SEQ ID NO: 7867 - DNA, 1423 bp, Homo sapiens
  ENST00000542722
ttggccaaagggatcccaggaggcctggccctcttttctcctgaggctggatcccaaccagcaggaaaaggctggattttcgccttttgtatttgttttggggcccaaccaagaaaaacagtggagggggaataaaacatgtttaaatcttttttttgtcttaaaaccatctttaatttcacagtcacaaaataaaacataactcgaatgttttgatgtttgcagtgacatcgattgtgaaaaagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgctccggggcttgtgtggggacagccagcctcctcgtgttgatttctgatcacctggtacctggtcgcgataaggcaggactgagacgttttttctccgttttggacaccggcttaagtagttaaaactaccgcaggcagtgagtaggaacagaaaagtattaggtatctttcagcatccgggcgttttccccattaccccctcccccgcccacttgcctggtgtttctctaatgcaggctgcgcagccgaattggagggcagaatatggcttaagtggtagggggaccagcagctgttggattttggaaatggaggagcggagattttaaaattgtgctctttatcttcaggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggcttt

SEQ ID NO: 7868 - DNA, 553 bp, Homo sapiens
  ENST00000545859
gtatttgttttggggcccaaccaagaaaaacagtggagggggaataaaacatgtttaaatcttttttttgtcttaaaaccatctttaatttcacagtcacaaaataaaacataactcgaatgttttgatgtttgcagtgacatcgattgtgaaaaaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctga

SEQ ID NO: 7869 - DNA, 1957 bp, Homo sapiens
  ENST00000266458
ctgggcgcctggcgcatggggggcggggcggggctcgcggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 7870 - DNA, 855 bp, Homo sapiens
  ENST00000421801
ggctcgcggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggtaatggttctggttgcacaatactggatgccgtccagtgcagtctggcatcctctagcccttgttctagatgcgttgataacacatctgagaagtggggcagaaggtgttatttatccggatcctcttacatatggcagtgtaaggctctgagagattagatacctcttgttttttagggattagccactctactagatttaatccttctgaaatcttgtctgactatagtcttgtctgactatagtgttttaatgctggactgtttattga

SEQ ID NO: 7871 - DNA, 531 bp, Homo sapiens
  ENST00000544284
acagcccgacgcgccacccagctgtttttgtgctcccagctctagcgaaaagccgccggtatttctccatctggctctcctctacctccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaagg

SEQ ID NO: 7872 - DNA, 559 bp, Homo sapiens
  ENST00000545047
gtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccttggccagttctacttcttaatccggaagagaatccacctgagacctgaggacgccttattcttctttgtcaacaacaccatccctcccaccagtgctaccatgggccaactgtatgaggtaatggttctggttgcacaatactggatgccgtccagtgcagtctggcatcctctagcccttgttctagatgcgttgataacacatctgagaagtg

SEQ ID NO: 7873 - DNA, 584 bp, Homo sapiens
  ENST00000541453
gtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgt

SEQ ID NO: 7874 - DNA, 653 bp, Homo sapiens
  ENST00000543602
gtgctcccagctctagcgaaaagccgccggtatttctccatctggctctcctctacctccaggcaggctcacccgagatccccgccccgaaccccccctgcacactcggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggtaatggttctggttgcacaatactggatgccgtccagtgcagtctggcatcctctagcccttgttctagatgcgttgataacacatctgagaagtggggcagaaggtgttatttatccggatcctcttacatatggcagtgtaaggctctgagagattagatacctcttgttttttagggattagccactctactagatttaatccttctgaaatcttg

SEQ ID NO: 7875 - DNA, 2321 bp, Homo sapiens
  ENST00000540424
agcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgctccggggcttgtgtggggacagccagcctcctcgtgttgatttctgatcacctggtacctggtcgcgataaggcaggactgagacgttttttctccgttttggacaccggcttaagtagttaaaactaccgcaggcagtgagtaggaacagaaaagtattaggtatctttcagcatccgggcgttttccccattaccccctcccccgcccacttgcctggtgtttctctaatgcaggctgcgcagccgaattggagggcagaatatggcttaagtggtagggggaccagcagctgttggattttggaaatggaggagcggagattttaaaattgtgctctttatcttcagatggagtattcaaagcacaaagaaatgcagtaacttcctaaaggtttcacattgctgatctgtggttgagctggaattccaaccctgtctgaaggactgtggagctctcgggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttacctt

SEQ ID NO: 7876 - DNA, 572 bp, Homo sapiens
  ENST00000537201
atctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgctccggggcttgtgtggggacagccagcctcctcgtgttgatttctgatcacctggtacctggtcgcgataaggcaggactgagacgttttttctccgttttggacaccggcttaagtagttaaaactaccgcaggcagctgcgcagccgaattggagggcagaatatggcttaagtggtagggggaccagcagctgttggattttggaaatggaggagcggagattttaaaattgtgctctttatcttcagatggagtattcaaagcacaaa

SEQ ID NO: 7877 - DNA, 571 bp, Homo sapiens
  ENST00000545887
ctctcctctacctccaggcaggctcacccgagatccccgccccgaaccccccctgcacactcggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacat

SEQ ID NO: 7878 - DNA, 3214 bp, Homo sapiens
  ENST00000541960
atctcggaagccctgcggtgcatcatgaagttccagtacaaggaggaccatccctttgagtatcggaaaaaggaaggagaaaagatccggaagaaatatccggacagggtccccgtgagtgtagaggagcggaggggatgggaggggaagggcccgcgggggcgggggcgggtagtcgagatggcttccctggggcgcccaggcggctctggagaagggaggttccgagaattacttaatcctgaacgcccttcagtgccagagccaatggacgtccagactgtagagcttttaaaaccccgtatgcctgggccccgaaccccacttcagggctgacggcgttttgggggccgagccgccgtcttcagtgactcagcaacccacacacggtctcagcagctgagaccgtgtgtgggttgcggtgcacaaaatagggcccctgtgggcgagactggttagatcggggccatggattggctgcctttaagaacgcagggacattgtgctgtgcggtgaggtttgcgcaaacccagtcgatttctgccttggctggttctcctttaatgaagttgactttggctctcatatcattggtcttgggacgaaaaggttcagaagctattcagtaattttcttgcattacagggggttaggggagcacaagacagtcctggcctggaaaacaaggtcacgttctctgcccaacagccctcttgcctcatcgttctaggctccggggcttgtgtggggacagccagcctcctcgtgttgatttctgatcacctggtacctggtcgcgataaggcaggactgagacgttttttctccgttttggacaccggcttaagtagttaaaactaccgcaggcagtgagtaggaacagaaaagtattaggtatctttcagcatccgggcgttttccccattaccccctcccccgcccacttgcctggtgtttctctaatgcaggctgcgcagccgaattggagggcagaatatggcttaagtggtagggggaccagcagctgttggattttggaaatggaggagcggagattttaaaattgtgctctttatcttcaggtaggaacattagtattacgtgtcacataatggtaaaataattgctgttatctgatgtcttttcttgactcacagccactctgggtttcttctctaatccttacctaacgttcgtggttttatagctaccagaagccaccagggccttagcccagcagtagaaacctcttgtaacccttttcctttaaaaagaaaaaaaagtcattagggctcttcattccccaggaattacaaaaaggttttcagcttatagaggggtgagctaatcccttactcgggaaaggatcctttacaaattactttcctggtttctggaccttggatacctgaaaattttgcccagttctggtgataccaatcttttgagcaatgatatttaaaaaatacaatcaagttttattgatagtttaccctagcggtattataagtactcagtctgtaatcattgacttacttccttacacgattacccgttctacagatggagtattcaaagcacaaagaaatgcagtaacttcctaaaggtttcacattgctgatctgtggttgagctggaattccaaccctgtctgaaggactgtggagctctcgggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaa

SEQ ID NO: 7879 - DNA, 565 bp, Homo sapiens
  ENST00000539289
acttcagggctgacggcgttttgggggccgagccgccgtcttcagtgactcagcaacccacacacggtctcagcagctgagaccgtgtgtgggttgcggtgcacaaaatagggcccctgtgggcgagactggttagatcggggccatggattggctgcctttaagaacgcagggacattgtgctgtgcggtgaggtttgcgcaaacccagtcgatttctgccttggctggttctcctttaatgaagttgactttggctctcatatcattggtcttgggacgaaaaggctgcgcagccgaattggagggcagaatatggcttaagtggtagggggaccagcagctgttggattttggaaatggaggagcggagattttaaaattgtgctctttatcttcaggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccct

SEQ ID NO: 7880 - DNA, 2294 bp, Homo sapiens
  ENST00000546017
acttcagggctgacggcgttttgggggccgagccgccgtcttcagtgactcagcaacccacacacggtctcagcagctgagaccgtgtgtgggttgcggtgcacaaaatagggcccctgtgggcgagactggttagatcggggccatggattggctgcctttaagaacgcagggacattgtgctgtgcggtgaggtttgcgcaaacccagtcgatttctgccttggctggttctcctttaatgaagttgactttggctctcatatcattggtcttgggacgaaaaggttcagaagctattcagtaattttcttgcattacagggggttaggggagcacaagacagtcctggcctggaaaacaaggtcacgttctctgcccaacagccctcttgcctcatcgttctaggctccggggcttgtgtggggacagccagcctcctcgtgttgatttctgatcacctggtacctggtcgcgataaggcaggactgagacgttttttctccgttttggacaccggcttaagtagttaaaactaccgcaggcagtgagtaggaacagaaaagtattaggtatctttcagcatccgggcgttttccccattaccccctcccccgcccacttgcctggtgtttctctaatgcaggctgcgcagccgaattggagggcagaatatggcttaagtggtagggggaccagcagctgttggattttggaaatggaggagcggagattttaaaattgtgctctttatcttcaggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttacctt

SEQ ID NO: 7881 - DNA, 792 bp, Homo sapiens
  ENST00000535576
gacggcgttttgggggccgagccgccgtcttcagtgactcagcaacccacacacggtctcagcagctgagaccgtgtgtgggttgcggtgcacaaaatagggcccctgtgggcgagactggttagatcggggccatggattggctgcctttaagaacgcagggacattgtgctgtgcggtgaggtttgcgcaaacccagtcgatttctgccttggctggttctcctttaatgaagttgactttggctctcatatcattggtcttgggacgaaaaggctccggggcttgtgtggggacagccagcctcctcgtgttgatttctgatcacctggtacctggtcgcgataaggcaggactgagacgttttttctccgttttggacaccggcttaagtagttaaaactaccgcaggcagctgcgcagccgaattggagggcagaatatggcttaagtggtagggggaccagcagctgttggattttggaaatggaggagcggagattttaaaattgtgctctttatcttcaggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatga

SEQ ID NO: 7882 - DNA, 1700 bp, Homo sapiens
  ENST00000539170
gacggcgttttgggggccgagccgccgtcttcagtgactcagcaacccacacacggtctcagcagctgagaccgtgtgtgggttgcggtgcacaaaatagggcccctgtgggcgagactggttagatcggggccatggattggctgcctttaagaacgcagggacattgtgctgtgcggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaat

SEQ ID NO: 7883 - DNA, 582 bp, Homo sapiens
  ENST00000545290
gcaaacccagtcgatttctgccttggctggttctcctttaatgaagttgactttggctctcatatcattggtcttgggacgaaaaggttcagaagctattcagtaattttcttgcattacagggggttaggggagcacaagacagtcctggcctggaaaacaaggtcacgttctctgcccaacagccctcttgcctcatcgttctaggctccggggcttgtgtggggacagccagcctcctcgtgttgatttctgatcacctggtacctggtcgcgataaggcaggactgagacgttttttctccgttttggacaccggcttaagtagttaaaactaccgcaggcagtgagtaggaacagaaaagtattaggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgagg

SEQ ID NO: 7884 - DNA, 379 bp, Homo sapiens
  ENST00000629504
gtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgctccggggcttgtgtggggacagccagcctcctcgtgttga

SEQ ID NO: 7885 - DNA, 4510 bp, Homo sapiens
  ENST00000425097
cccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7886 - DNA, 4070 bp, Homo sapiens
  ENST00000446436
agtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7887 - DNA, 4299 bp, Homo sapiens
  ENST00000443440
gcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7888 - DNA, 2364 bp, Homo sapiens
  ENST00000466282
atgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctc

SEQ ID NO: 7889 - DNA, 659 bp, Homo sapiens
  ENST00000492358
gtgcaggagaggtgatgggtaaggctccagatggaagacagagaaggaagtttaatgaaagaggagaaaaaaggcacttgacaggaagagatgccagaaaggagaagaaaacggtaattaatgatgaaagtgagtaattgagaaaggaactaatttgttcgagaaagataagagcaggaattgcagacaggggaggggccccaggagagcttgccctcatctcctcttgtctttcagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccg

SEQ ID NO: 7890 - DNA, 486 bp, Homo sapiens
  ENST00000475099
ttgagggtctcataggaaaacagttggaagccagagactgagaagcgttgaggagaggaggggaggctggcaaccatctttcttgtgaccttgtttctgccctagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtgagcactgaccccatggcattgaccctgtaggctgaccacagcagcccagatatagaggactaggaagaatcaatgctagatctgggatcggttgcttagaagtcttaaaaagtttgttaattcttcaggtctataaagcactttacagtttacaaa

SEQ ID NO: 7891 - DNA, 837 bp, Homo sapiens
  ENST00000493150
tttctcaatctatatttgaggatgatcctgaatttggatccttttcaaagggaaagttcaccaggaaactgtctgcatagactccctcccatgggaagtaaactctggatcttgtctgagcctgcagacctgagactccctcaatgtgtctttccctctaggtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacct

SEQ ID NO: 7892 - DNA, 3523 bp, Homo sapiens
  ENST00000417759
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatgttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 7893 - DNA, 4220 bp, Homo sapiens
  ENST00000471103
gaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7894 - DNA, 1802 bp, Homo sapiens
  ENST00000497560
ttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttgctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7895 - DNA, 1252 bp, Homo sapiens
  ENST00000472409
ggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccagggtgaggggaacagctgcctgcatgcagctgatgaggacgcttgtgtgaggatgggagtggggtgggaatggataatgggaaagaatggagagctataaaaatgtgggggaggacactggaaaggggagatgaaagtccctttttcctccatcacctgcctcaaacttcctcttgcagtccccggtatcctctgtaggttgggggcttccttcctttaccttttaaaaaaatcttcctgctcccgattcttagacctcacgttttctcttttcctttatgaatctcacctctctcaccttcttcaggtttaaatactccaattttccctttctctaaacttagaaatttccatgcatcaccctcttctagaattcatccctcaccattccttatataattgatttattgtaaagactcagaaataaatcaaacattctactaagaaaaattgagaaggggagctctgggggtggaaacatattagggtaaaagacttaaaattggaggcagcattatcagaagatgaagaacaactcagggatggggtgggaagaagaca

SEQ ID NO: 7896 - DNA, 407 bp, Homo sapiens
  ENST00000481954
gatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagtttcctttcgtctgccaggtgaggaggtggtgggcaaattccttacaggatgtgactctcccacccgtctcaggagcaccttccatgatttatgattctctgcccttcctcctcagctttccctgactcttgtccctgttctttccttctagcatcacccctctg

SEQ ID NO: 7897 - DNA, 1739 bp, Homo sapiens
  ENST00000551140
agatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctga

SEQ ID NO: 7898 - DNA, 3506 bp, Homo sapiens
  ENST00000355973
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatgttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaa

SEQ ID NO: 7899 - DNA, 4286 bp, Homo sapiens
  ENST00000472823
gggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtggcaccctcccctcagaaacgcaggcttctgctctccccggtcttcagcatggacaggtgtgggagggggctggggatcaggccagggaagctgggcgccagtggtaactcttctctgatccccgtctttcctgctgccagtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcggca

SEQ ID NO: 7900 - DNA, 4299 bp, Homo sapiens; identical to SEQ ID NO: 7887
  ENST00000377016

SEQ ID NO: 7901 - DNA, 4104 bp, Homo sapiens
  ENST00000377012
acatctccctcctgctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtga

SEQ ID NO: 7902 - DNA, 4212 bp, Homo sapiens
  ENST00000491829
gaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtg

SEQ ID NO: 7903 - DNA, 4527 bp, Homo sapiens
  ENST00000377034
ccctctcttccccccgccctgccttcccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtg

SEQ ID NO: 7904 - DNA, 837 bp, Homo sapiens; identical to SEQ ID NO: 7891
  ENST00000478931

SEQ ID NO: 7905 - DNA, 2364 bp, Homo sapiens; identical to SEQ ID NO: 7888
  ENST00000494877

SEQ ID NO: 7906 - DNA, 579 bp, Homo sapiens
  ENST00000488334
cattatcttttagatcccccttggccttattagcattgttcgattcatggtcacaaattgcaaacctaccctctgcctggaaagccaccttcccacctgtagggtaagggtgaggcatgtgtggcccagactggcctatttctagatattcaacaagcccttgcctgactgacagcagcttgccaccattgctttcctgtgtgaatcccaggaaaaagtgatgtggtctgggcaagttgggtggacataagggataggggacacagggtgaggtttgctaggtcagaggggttggattggagaggagggccccctttccatttcagagtaggtgaagggcagagaggggatggggattgagtgaggagcattgtggtccttgttgctcaagtgactctctcctgccatcctaggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattct

SEQ ID NO: 7907 - DNA, 486 bp, Homo sapiens; identical to SEQ ID NO: 7890
  ENST00000486434

SEQ ID NO: 7908 - DNA, 582 bp, Homo sapiens
  ENST00000473774
aagagtctcgtaggtccttccaagcatccttagggcctcaggtgaaaataaaatcagatacaaccatgcaaagctctagggaagtgggaagttgaaaatgcctaggatcagctctttggctacctgtggtcactccttttattgtcgtctgcccaggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagattt

SEQ ID NO: 7909 - DNA, 407 bp, Homo sapiens; identical to SEQ ID NO: 7896
  ENST00000489839

SEQ ID NO: 7910 - DNA, 749 bp, Homo sapiens
  ENST00000494634
tttgcctcttgaggttgacatcatgctgtctgtcccagtccttgccttgtcttttcctggttcctttatgtttctttaccccatctttgccttcagtggtaggagtgggtgaatggagtggcttcccccacacagagcctcagcaggggctcaccattcaccttcccacttggaatccacatcctaagaccagatgccttcccgaactcctcacttcagggacagaagctgttgaaggaaggttcagaatggctgcttctttgctctatctgagtattgctctgaaatccccagttaacctctctggtctttattccctcatgcaccccgtgtttttccaacttgttttttattcccacccaagactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaac

SEQ ID NO: 7911 - DNA, 659 bp, Homo sapiens; identical to SEQ ID NO: 7889
  ENST00000477029

SEQ ID NO: 7912 - DNA, 825 bp, Homo sapiens
  ENST00000485508
ctcttggtccccaggctgagcccggtcggagcctgcgaggcaaccggcaagaggtcgagtagtctccgggtgcgggccgcgccggcggggctcggtccagtcctcatggccgcctctcacttagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgcc

SEQ ID NO: 7913 - DNA, 871 bp, Homo sapiens
  ENST00000489385
gaggtcgagtagtctccgggtgcgggccgcgccggcggggctcggtccagtcctcatggccgcctctcacttagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccagggcaccctcccctcagaaacgcaggcttctgctctccccggtcttcagcatggacaggtgtgggagggggctggggatcaggccagggaagctgggcgccagtggtaactcttctctgatccccgtctttcctgctgccagtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaag

SEQ ID NO: 7914 - DNA, 1252 bp, Homo sapiens; identical to SEQ ID NO: 7895
  ENST00000467259

SEQ ID NO: 7915 - DNA, 609 bp, Homo sapiens
  ENST00000462632
acacacacacccctccacttcaaggtatagccaagagcttctggagccgtcaaaaaggtctgtacctgctgtctttagagcttccagtttgcccttggtcaagaaatactgtttgctaggctctgctggagtacatcagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactg

SEQ ID NO: 7916 - DNA, 487 bp, Homo sapiens
  ENST00000476670
agtgggcgcagggcccagctgggggaagcggggctgggggagaggaggaaccgcggggatggaatcggggagcgctgaggcggccgatgccgggagcgtggatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggattt

SEQ ID NO: 7917 - DNA, 1739 bp, Homo sapiens; identical to SEQ ID NO: 7897
  ENST00000376977

SEQ ID NO: 7918 - DNA, 4510 bp, Homo sapiens
  ENST00000383638
cccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacactgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7919 - DNA, 4070 bp, Homo sapiens
  ENST00000383636
agtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacactgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7920 - DNA, 4299 bp, Homo sapiens
  ENST00000383637
gcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacactgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7921 - DNA, 2364 bp, Homo sapiens; identical to SEQ ID NO: 7888
  ENST00000466873

SEQ ID NO: 7922 - DNA, 659 bp, Homo sapiens; identical to SEQ ID NO: 7889
  ENST00000473906

SEQ ID NO: 7923 - DNA, 407 bp, Homo sapiens; identical to SEQ ID NO: 7896
  ENST00000490214

SEQ ID NO: 7924 - DNA, 837 bp, Homo sapiens; identical to SEQ ID NO: 7891
  ENST00000486760

SEQ ID NO: 7925 - DNA, 486 bp, Homo sapiens; identical to SEQ ID NO: 7890
  ENST00000476629

SEQ ID NO: 7926 - DNA, 4220 bp, Homo sapiens
  ENST00000495153
gaagggaggggggagcggggaggagcggccgggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacactgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7927 - DNA, 3523 bp, Homo sapiens
  ENST00000383639
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcactgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 7928 - DNA, 1802 bp, Homo sapiens
  ENST00000483838
ttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttgctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacactgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7929 - DNA, 1252 bp, Homo sapiens; identical to SEQ ID NO: 7895
  ENST00000475370

SEQ ID NO: 7930 - DNA, 1739 bp, Homo sapiens; identical to SEQ ID NO: 7897
  ENST00000551423

SEQ ID NO: 7931 - DNA, 4509 bp, Homo sapiens
  ENST00000439457
cccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7932 - DNA, 4070 bp, Homo sapiens
  ENST00000452300
agtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7933 - DNA, 4298 bp, Homo sapiens
  ENST00000419674
gcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7934 - DNA, 2364 bp, Homo sapiens
  ENST00000481198
atgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctc

SEQ ID NO: 7935 - DNA, 659 bp, Homo sapiens; identical to SEQ ID NO: 7889
  ENST00000491396

SEQ ID NO: 7936 - DNA, 486 bp, Homo sapiens; identical to SEQ ID NO: 7890
  ENST00000477417

SEQ ID NO: 7937 - DNA, 837 bp, Homo sapiens; identical to SEQ ID NO: 7891
  ENST00000486592

SEQ ID NO: 7938 - DNA, 3523 bp, Homo sapiens
  ENST00000449163
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcactgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 7939 - DNA, 4219 bp, Homo sapiens
  ENST00000489750
gaagggaggggggagcggggaggagcggccggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7940 - DNA, 1802 bp, Homo sapiens
  ENST00000461230
ttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttgctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7941 - DNA, 1251 bp, Homo sapiens
  ENST00000467296
ggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccggcctggggccttgaggcccggggagagccggggagccgggcccgcgcgccgagatgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccagggtgaggggaacagctgcctgcatgcagctgatgaggacgcttgtgtgaggatgggagtggggtgggaatggataatgggaaagaatggagagctataaaaatgtgggggaggacactggaaaggggagatgaaagtccctttttcctccatcacctgcctcaaacttcctcttgcagtccccggtatcctctgtaggttgggggcttccttcctttaccttttaaaaaaatcttcctgctcccgattcttagacctcacgttttctcttttcctttatgaatctcacctctctcaccttcttcaggtttaaatactccaattttccctttctctaaacttagaaatttccatgcatcaccctcttctagaattcatccctcaccattccttatataattgatttattgtaaagactcagaaataaatcaaacattctactaagaaaaattgagaaggggagctctgggggtggaaacatattagggtaaaagacttaaaattggaggcagcattatcagaagatgaagaacaactcagggatggggtgggaagaagaca

SEQ ID NO: 7942 - DNA, 407 bp, Homo sapiens
  ENST00000481333
gatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagttccctttcgtctgccaggtgaggaggtggtgggcaaattccttacaggatgtgactctcccacccgtctcaggagcaccttccatgatttatgattctctgcccttcctcctcagctttccctgactcttgtccctgttctttccttctagcatcacccctctg

SEQ ID NO: 7943 - DNA, 1739 bp, Homo sapiens; identical to SEQ ID NO: 7897
  ENST00000547410

SEQ ID NO: 7944 - DNA, 4199 bp, Homo sapiens
  ENST00000546913
atgttgctgctgctgctactggcgccactcttcctccgccccccgggcgcgggcggggcgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttccatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7945 - DNA, 4510 bp, Homo sapiens; identical to SEQ ID NO: 7885
  ENST00000383542

SEQ ID NO: 7946 - DNA, 4070 bp, Homo sapiens; identical to SEQ ID NO: 7886
  ENST00000383537

SEQ ID NO: 7947 - DNA, 4299 bp, Homo sapiens; identical to SEQ ID NO: 7887
  ENST00000383541

SEQ ID NO: 7948 - DNA, 2364 bp, Homo sapiens; identical to SEQ ID NO: 7888
  ENST00000495291

SEQ ID NO: 7949 - DNA, 659 bp, Homo sapiens; identical to SEQ ID NO: 7889
  ENST00000489481

SEQ ID NO: 7950 - DNA, 486 bp, Homo sapiens; identical to SEQ ID NO: 7890
  ENST00000482350

SEQ ID NO: 7951 - DNA, 837 bp, Homo sapiens; identical to SEQ ID NO: 7891
  ENST00000498610

SEQ ID NO: 7952 - DNA, 3523 bp, Homo sapiens
  ENST00000383543
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 7953 - DNA, 4220 bp, Homo sapiens; identical to SEQ ID NO: 7893
  ENST00000493602

SEQ ID NO: 7954 - DNA, 1802 bp, Homo sapiens; identical to SEQ ID NO: 7894
  ENST00000471385

SEQ ID NO: 7955 - DNA, 1252 bp, Homo sapiens; identical to SEQ ID NO: 7895
  ENST00000462863

SEQ ID NO: 7956 - DNA, 407 bp, Homo sapiens; identical to SEQ ID NO: 7896
  ENST00000478066

SEQ ID NO: 7957 - DNA, 1739 bp, Homo sapiens; identical to SEQ ID NO: 7897
  ENST00000552399

SEQ ID NO: 7958 - DNA, 3523 bp, Homo sapiens
  ENST00000438094
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttacggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 7959 - DNA, 1802 bp, Homo sapiens; identical to SEQ ID NO: 7894
  ENST00000460735

SEQ ID NO: 7960 - DNA, 4220 bp, Homo sapiens; identical to SEQ ID NO: 7893
  ENST00000486623

SEQ ID NO: 7961 - DNA, 4299 bp, Homo sapiens; identical to SEQ ID NO: 7887
  ENST00000434660

SEQ ID NO: 7962 - DNA, 4510 bp, Homo sapiens; identical to SEQ ID NO: 7885
  ENST00000423604

SEQ ID NO: 7963 - DNA, 4065 bp, Homo sapiens
  ENST00000414980
agtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagtttcctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtga

SEQ ID NO: 7964 - DNA, 837 bp, Homo sapiens; identical to SEQ ID NO: 7891
  ENST00000483304

SEQ ID NO: 7965 - DNA, 2364 bp, Homo sapiens; identical to SEQ ID NO: 7888
  ENST00000470098

SEQ ID NO: 7966 - DNA, 486 bp, Homo sapiens; identical to SEQ ID NO: 7890
  ENST00000487021

SEQ ID NO: 7967 - DNA, 407 bp, Homo sapiens; identical to SEQ ID NO: 7896
  ENST00000474366

SEQ ID NO: 7968 - DNA, 659 bp, Homo sapiens; identical to SEQ ID NO: 7889
  ENST00000468622

SEQ ID NO: 7969 - DNA, 1252 bp, Homo sapiens; identical to SEQ ID NO: 7895
  ENST00000463819

SEQ ID NO: 7970 - DNA, 1739 bp, Homo sapiens; identical to SEQ ID NO: 7897
  ENST00000548767

SEQ ID NO: 7971 - DNA, 4510 bp, Homo sapiens
  ENST00000418225
cccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggtgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccatatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7972 - DNA, 4070 bp, Homo sapiens
  ENST00000458612
agtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccatatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7973 - DNA, 4299 bp, Homo sapiens
  ENST00000440316
gcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggtgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccatatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7974 - DNA, 2364 bp, Homo sapiens
  ENST00000496339
atgttgctgctgctgctactggcgccactcttcctccgccccccgggcgcgggcggggtgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctc

SEQ ID NO: 7975 - DNA, 659 bp, Homo sapiens
  ENST00000491155
gtgcaggagaggtgatgggtaaggctccagatggaagacagagaaggaagtttaatgaaagaggagaaaaaaggcacttgacaggaagagatgccagaaaggagaagaaaacggtaattaatgatgaaagtgagtaattgagaaaggaactaatttgttcgagaaagataagagtaggaattgcagacaggggaggggccccaggagagcttgccctcatctcctcttgtctttcagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccg

SEQ ID NO: 7976 - DNA, 486 bp, Homo sapiens; identical to SEQ ID NO: 7890
  ENST00000475876

SEQ ID NO: 7977 - DNA, 837 bp, Homo sapiens; identical to SEQ ID NO: 7891
  ENST00000473033

SEQ ID NO: 7978 - DNA, 3523 bp, Homo sapiens
  ENST00000448754
ctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcactgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 7979 - DNA, 4220 bp, Homo sapiens
  ENST00000464091
gaagggaggggggagcggggaggagcggccgggcctggggccttgaggcccggggagagccggggagccgggcccgcgcgccgagatgttgctgctgctgctactggcgccactcttcctccgccccccgggcgcgggcggggtgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctgtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccgttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttggcattttctatggttacaaggggctgctgctgctgctgggaatcttccttgcttatgagaccaagagtgtgtccactgagaagatcaatgatcaccgggctgtgggcatggctatctacaatgtggcagtcctgtgcctcatcactgctcctgtcaccatgattctgtccagccagcaggatgcagcctttgcctttgcctctcttgccatagttttctcctcctatatcactcttgttgtgctctttgtgcccaagatgcgcaggctgatcacccgaggggaatggcagtcggaggcgcaggacaccatgaagacagggtcatcgaccaacaacaacgaggaggagaagtcccggctgttggagaaggagaaccgtgaactggaaaagatcattgctgagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccatatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7980 - DNA, 1802 bp, Homo sapiens
  ENST00000496077
ttatatccagaactcacagcccaacctgaacaacctgactgctgtgggctgctcactggctttagctgctgtcttccccctggggctcgatggttaccacattgggaggaaccagttccctttcgtctgccaggcccgcctctggctcctgggcctgggctttagtctgggctacggttccatgttcaccaagatttggtgggtccacacggtcttcacaaagaaggaagaaaagaaggagtggaggaagactctggaaccctggaagctgtatgccacagtgggcctgctggtgggcatggatgtcctcactctcgccatctggcagatcgtggaccctctgcaccggaccattgagacatttgccaaggaggaacctaaggaagatattgacgtctctattctgccccagctggagcattgcagctccaggaagatgaatacatggcttgctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccatatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcgg

SEQ ID NO: 7981 - DNA, 1252 bp, Homo sapiens
  ENST00000460802
ggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggccgggcctggggccttgaggcccggggagagccggggagccgggcccgcgcgccgagatgttgctgctgctgctactggcgccactcttcctccgccccccgggcgcgggcggggtgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccagggtgaggggaacagctgcctgcatgcagctgatgaggacgcttgtgtgaggatgggagtggggtgggaatggataatgggaaagaatggagagctataaaaatgtgggggaggacattggaaaggggagatgaaagtccctttttcctccatcacctgcctcaaacttcctcttgcagtccccggtatcctctgtaggttgggggcttccttcctttaccttttaaaaaaatcttcctgctcccgattcttagacctcacgttttctcttttcctttatgaatctcacctctctcaccttcttcaggtttaaatactccaattttccctttctctaaacttagaaatttccatgcatcaccctcttctagaattcatccctcaccattccttatataattgatttattgtaaagactcagaaataaatcaaacattctactaagaaaaattgagaaggggagctctgggggtggaaacatattagggtaaaagacttaaaattggaggcagcattatcagaagatgaagaacaactcagggatggggtgggaagaagaca

SEQ ID NO: 7982 - DNA, 407 bp, Homo sapiens; identical to SEQ ID NO: 7942
  ENST00000482516

SEQ ID NO: 7983 - DNA, 1739 bp, Homo sapiens
  ENST00000550820
agatgttgctgctgctgctactggcgccactcttcctccgccccccgggcgcgggcggggtgcagacccccaacgccacctcagaaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtgtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccaggtgaatcgaacgccacactcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaagtgtgatccaggccaagccaccaagtacctatatgagctgctctacaacgaccctatcaagatcatccttatgcctggctgcagctctgtctccacgctggtggctgaggctgctaggatgtggaacctcattgtgctttcctatggctccagctcaccagccctgtcaaaccggcagcgtttccccactttcttccgaacgcacccatcagccacactccacaaccctacccgcgtgaaactctttgaaaagtggggctggaagaagattgctaccatccagcagaccactgaggtcttcacttcgactctggacgacctggaggaacgagtgaaggaggctggaattgagattactttccgccagagtttcttctcagatccagctgtgcccgtcaaaaacctgaagcgccaggatgcccgaatcatcgtgggacttttctatgagactgaagcccggaaagttttttgtgaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatgacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttccggcgtgcgcctggaggacttcaactacaacaaccagaccattaccgaccaaatctaccgggcaatgaactcctcgtcctttgagggtgtctctggccatgtggtgtttgatgccagcggctctcggatggcatggacgcttatcgagcagcttcagggtggcagctacaagaagattggctactatgacagcaccaaggatgatctttcctggtccaaaacagataaatggattgttatatccagaactcacagcccaacctga

SEQ ID NO: 7984 - DNA, 5788 bp, Homo sapiens
  ENST00000259455
gccgcccctgagcagcctcgccttcgcctcccgcgtttcctgccgtccgccctcccccggccgagctccaggggctgccgcctagcagctcccggcgggagagcggttcagagcgcgcacgggggcgggcggaggcggcccggtgcggggcggccgcgctggagagaggcgcgcgcggagacgccggcccccctctccgcgtttgctcgcttgctccccgcctcccgcactccgctcgctcccaccccttcccggcgtgattgatccgtcacgggcgccgccgctgccgccgccgccgccgcggccgttctgagccgagccggaaccctagcccgagacggagccggggcccgggccggcgccattgcgcgggcgccgcgggaagaccttggcgcggggcggcgggccgggccaggccatgcgggccgagtgagccggcgcccgcagcccgcggcgcggcatggcttccccgcggagctccgggcagcccgggccgccgccgccgccgccaccgccgcccgcgcgcctgctactgctactgctgctgccgctgctgctgcctctggcgcccggggcctggggctgggcgcggggcgccccccggccgccgcccagcagcccgccgctctccatcatgggcctcatgccgctcaccaaggaggtggccaagggcagcatcgggcgcggtgtgctccccgccgtggaactggccatcgagcagatccgcaacgagtcactcctgcgcccctacttcctcgacctgcggctctatgacacggagtgcgacaacgcaaaagggttgaaagccttctacgatgcaataaaatacgggcctaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcctacctcccatccatcggaggcgtggacgccagctgtgtcagcccctgcgtcagccccaccgccagcccccgccacagacatgtgccaccctccttccgagtcatggtctcgggcctgtaagggtgggaggcctgggcccggggcctcccccgtgacagaaccacactgggcagaggggtctgctgcagaaacactgtcggctctggctgcggagaagctgggcaccatggctggcctctcaggaccactcggatggcactcaggtggacaggacggggcagggggagacttggcacctgacctcgagccttatttgtgaagtccttatttcttcacaaagaagaggaacggaaatgggacgtcttccttaacatctgcaaacaaggaggcgctgggatatcaaacttgcaaaaaaaaaaaaaaaaaaaaaaaaacaaaaaaactagacaaggagagaggcactagaactccagctggaagtcacggagtggctcgagcagccttgggaagaggcaaggagcttctgaagaaactgcctctgcacacacatcactggctgtgacccctcaggctagcccttctccactctgggggaggaggtgggaagggccaccaggcccccagctgccaggccagctgaccccagccttcctggaacagggagtctgcaggagcgcagacaggcacagccctggagcaggcaggccgagggctgcggcactggagcaggctgacttacatgctccacatgggacctgtgtcacccaatgagatgtttgttactctggtaaatgccacacgttaacacaataacacccattcctgggaccgtggggatttagggcacgtcactgcagacacgctctgcagcattcaccgacagtctgtcatgcacccaccacgttggccatgtccttgtgttcctatcggatgctcccagtaaccagggggaccacccgagctaatcatggaatgtctgttcccagcaaacacgataaagaaagattgtgcactttaacctctctcatcagggcccaagggctggctgggattttttttttttttttcccactaactttgtttctgaccaaagtgaattggaggcactctgctaaaagacatccccgtagacataggggagagagttgctggctgagggcttcccttggcttccagaaggcagccttccatccagacaagccagtgagctctccccttgggatcactggggtgatcagtcagcagattgattctcattcataagatcattcctccctttaaattgagcccctaagagcactggcctgggagtcagacagacctgggttcaagtcctcagtcccctgcccactccctacgtgactttgatcaggtcactagtgtctctctgagcctcagtttcccctctgtaacttggggttgaactaaaacacctgtcctgcctacctcacaaggtcactctgaggattgaaacttgatcttgtccaggaaagctttgtaccaaacagtgaagccgccctgatccgtgaggtatgagtatgactctgaccttcagccctccctacagccgggggtgtggcccagagaagcttccagcacagccctctacccagaacatccgggctggagggaggctcccagtgacttttctgacattcctagacaggttcattctttgctcaagaaaggcctgaatgacaatgtccaggatgtctgcacaactgagcagctcgctcactccctaaagaaacctattggcagcttcaacaggcaggcaataatctcttcccagaaccactgcagtcaggaataaactgttttctccaccaggctttgacaaaagggcccacaggaatcttaccaatgccaacatttcaaagcaccctatttcacgtagcatagctttctgctccccttccccaaagagaggttatggaggtactgtagcttttagggaaaaaaaaatgttaacacatcacaggtcaagttgaagtcattctctgtttaggcactaaaaatcggtgttgtcactcactgtgtattaccagtatttacttgctttcttgatttcaccaaaaccaaatttaatttaaaggaccacattaatttttcaaagggaaagagacaattaattgtacataatgtatacacacacacaaaaaaaaatacctgtagaaatattattccagcatagcaggaaaacaaacaaaagtattggactgtcggaggtgagcctgtgcgtctgtaaccctttgtgactcctgagcgtgcgctgtcttctaggttaactcacgaagtacattctctgtcttactgatactgtaggttcacccatttttttttaatttcctcgcaaataacaagacccacagaagtgactctagctacttaatggttctgttcttttatatgcagcaaacacaccgtccatttctgaagaggcttcggcctgaaggcattttccaatgatgttagtgcacaaaacgctttaaattagactggaactgccagaatcaaatgtaaatgaggaatttctcgtacccctactgcatggtatcgatttttaataaattgttgcaaatttgtttttatgaataaaaggaaaaaacctgtcgtctttaa

SEQ ID NO: 7985 - DNA, 2541 bp, Homo sapiens
  ENST00000637410
gcagtgcccacagcctggatctgcctctgtcccacagcaccagccaccatcccccacgggaggtgactgcgtgccccggcctcactgcctccaccatcgtgcgacaacgcaaaagggttgaaagccttctacgatgcaataaaatacgggcctaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcctacctcccatccatcggaggcgtggacgccagctgtgtcagcccctgcgtcagcccc

SEQ ID NO: 7986 - DNA, 148 bp, Homo sapiens
  ENST00000636575
gtccacctcggtcaccagtgtgaaccaagccagcacatcccgcctggagggcctacagtcagaaaaccatcgcctgcgaatgaagatcacagagtttttcactctcccagcacaacccagcaaccaccacatctatgtgatgtacaag

SEQ ID NO: 7987 - DNA, 550 bp, Homo sapiens
  ENST00000634457
gtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtcca

SEQ ID NO: 7988 - DNA, 563 bp, Homo sapiens
  ENST00000634354
gacagctgtcacatccccagtctgcatttgctcagcaggactcagcagggccacaagtggggacagatggtgacatccagaagacccggctgacagcaaggcccccgaccctccctccctgcagcccacctcctgagtaaccctccactccacagcttctcagagcagcctgtgtgtgccaccccttggtaacgatcatctctcccctttctgttcaccatttcagttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaaggcctccctgcgttgccagacaccagttcttcccttggagttcccttccccccaccatccctccagaccgccctcaaagcccagcaggccatggcactgtggtaggctgtccc

SEQ ID NO: 7989 - DNA, 631 bp, Homo sapiens
  ENST00000635462
aagtttggatttcagaggatgcatgagaagttgtgaagaacaaggaatggcattttgggtggaggaaacagcgcgtgtcagacccggcagcatgagccagtgtgatgtgaggggaaagactgagcagggcaggatggtttgagaaatatcagaagaggtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctg

SEQ ID NO: 7990 - DNA, 558 bp, Homo sapiens
  ENST00000634314
ttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggaggtaagccctccatgccggcaggagggaagcctgcagatgcagcccctggcacatgaggacagtgaggctgcacagctcccagactgcccagtaccccactgggaacacttcatcagttccatttccttccatttgagacatgtaattccagggaggccaa

SEQ ID NO: 7991 - DNA, 831 bp, Homo sapiens
  ENST00000634919
agggctccctttgcagaccttggggccaggaggtgaaggtggagtgcatcctcagtgttcttgtctccttcttttattaccattctctgattgtgatgcccttgcttcctggatatgtccagttctgccatgcttctctttcccgtgtgtcctaatcgcttgctttttgccaggctttatatccagcatggatacacagagaggccccaacacagtctcaactccccagggcctgccagtctagagagggatgctcaaggaggaaagccactcactgggtcctctccctgcaggaaccacctaggggtgcggaatgacctgactggagttctgtatggcgaggacattgagatttcagacaccgagagcttctccaacgatccctgtaccagtgtcaaaaagctgaagcaaagaagtcttcttgttgcaactgaaagcccaggctcctgacccctatccggtgacactctctttaggaacagaaagggtcaacgagaagtttccccagttgggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggccc

SEQ ID NO: 7992 - DNA, 702 bp, Homo sapiens
  ENST00000477471
agggaagaaacagtgctgggagaactgagggagagcagggaaggctccctggaggaggtgtctgtgagtaggcctggacaaatgagtaggaagtatgatcccagaagtaagaaatgctgcatcctctcccactcaaagactcgagctggggccccagcacccccgacccctgacagatgtgatttcaacttgtggactgatcagaggtgccatattgacatgaggagacatgatttctgcagtgagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaag

SEQ ID NO: 7993 - DNA, 583 bp, Homo sapiens
  ENST00000634227
attttcaacttcagcaataccccaaggatgctgctttcctctgatcattttgccattaactttgatgatagtattactacctaccacaccaacagtgcgacaacgcaaaagggttgaaagccttctacgatgcaataaaatacgggcctaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgagga

SEQ ID NO: 7994 - DNA, 513 bp, Homo sapiens
  ENST00000637717
agcgatcgctggccgcgcaaggtcgggtttgcgagtttttccggaccgagcgagcccctgtgctccgaccgcagcgtctgagacgcggcctgaagggggcagtgatttcctgtgcagtacgctcggttggcgcctcttccatcgcgcggaacggggccgaggcgctgggcttgatcctggcttcctgggactctccgggcgcttctgctggagtccagtgcgacaacgcaaaagggttgaaagccttctacgatgcaataaaatacgggcctaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttc

SEQ ID NO: 7995 - DNA, 100 bp, Homo sapiens
  ENST00000638001
aattcgtcaatgccttggaatgtcataaagatcctgaagctgggagatgagtttacatttttcgtctggctttcttttgctgcaaccacgcctgttctag

SEQ ID NO: 7996 - DNA, 3411 bp, Homo sapiens
  ENST00000510861
gagaacaagctttagagatgataaaagcacagtatcttggcaaccttttgtgttgggttatttttaaaaaatggataatattgtgctctagttctcatttattcagctacttgctgagtgatagcaacattacaactacagaacctgtatgtcatcttgacattagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaattaaaaaaaaagaaaagaaatgtgtcttaacatttccaggtatgtgttgtattgaaattgatcagctaaattttacgggtgctggagactggaaaaagcatccagtttggttgctgtggagcaacatgcatattggattagaaaattgtgccaaaaactcccactgatgagaattcataggtgccccacactatgacaaacacttatatgattctcctctttcctgtttactgcaaattctgccttaaggcttcttttcaagactcagaagccactaattataaaggaaagggcagttaattggcacatttttctcttgtgaaagcagttctttcagataagaattaatgtaaatctgcttttgtaaattgcaactttaaatttcgctgactcaaatttacaacagctttgtataccagaagaggttttggtaagggttgaacatttttacactgcaactttaaaacatcaccaatagattgtggattatttcacgtgcacaaacatacacacacacacacacacacacacacatacacagctaaattagaaaacacaattttaaattttatataattactagttattaatgggtaaaattcatttttcttttaatatcttaaaatattatttatgccccgaaatatgctaataaaagttaaagattgtgtattatgcctagattcaaagtttttggcaaacttcaaatacttttgattgacatgtacattagcagttattagttgacttttactaaaacatgcacctttacgatggtgtttttgtagaaacataagtagtcaaatagtaacatttattgcagttttgtacagtatttgagtatagtgcataaataggtatgttcataaaatcaataaaaggagtatctatggaaataagcaaaatatcagcaaaaattgctattcctttgcctcatttaatttttaaaatttctttgtttccatgtgattctattatatgctttgcatgcttgtataaaaccaaggtcacaaatgcaacttattaacggaatttgccaagaagacagccttgacattaaaaattccctcacaagaggtaatccataatccttaataaaataaaattgttacatgagccaataaatgtatttctttaattcc

SEQ ID NO: 7997 - DNA, 3401 bp, Homo sapiens
  ENST00000514090
tcaaacgcgtcgtttcgcagcacttgatcggaacccggctgcctctaagacttggtcttgggcaaccgtgggtgggcaggaagggaaattatttattttattttgttaaggggagtgaagaaaagaagacgtgaggaccgcagttcactgtaatgtagagtaattgcaaaaagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaattaaaaaaaaagaaaagaaatgtgtcttaacatttccaggtatgtgttgtattgaaattgatcagctaaattttacgggtgctggagactggaaaaagcatccagtttggttgctgtggagcaacatgcatattggattagaaaattgtgccaaaaactcccactgatgagaattcataggtgccccacactatgacaaacacttatatgattctcctctttcctgtttactgcaaattctgccttaaggcttcttttcaagactcagaagccactaattataaaggaaagggcagttaattggcacatttttctcttgtgaaagcagttctttcagataagaattaatgtaaatctgcttttgtaaattgcaactttaaatttcgctgactcaaatttacaacagctttgtataccagaagaggttttggtaagggttgaacatttttacactgcaactttaaaacatcaccaatagattgtggattatttcacgtgcacaaacatacacacacacacacacacacacacacatacacagctaaattagaaaacacaattttaaattttatataattactagttattaatgggtaaaattcatttttcttttaatatcttaaaatattatttatgccccgaaatatgctaataaaagttaaagattgtgtattatgcctagattcaaagtttttggcaaacttcaaatacttttgattgacatgtacattagcagttattagttgacttttactaaaacatgcacctttacgatggtgtttttgtagaaacataagtagtcaaatagtaacatttattgcagttttgtacagtatttgagtatagtgcataaataggtatgttcataaaatcaataaaaggagtatctatggaaataagcaaaatatcagcaaaaattgctattcctttgcctcatttaatttttaaaatttctttgtttccatgtgattctattatatgctttgcatgcttgtataaaaccaaggtcacaaatgcaacttattaacggaatttgccaagaagacagccttgacattaaaaattccctcacaagaggtaatccataatccttaataaaataaaattgttacatgagccaataaa

SEQ ID NO: 7998 - DNA, 2525 bp, Homo sapiens
  ENST00000381620
cctagcgctcctctccggcttccaccagcccatcgctccacgctctcttggctgctgcagtctcggtctctctctctctctctctctctctctctctctctctctctctctctctctctctctctcccaagtttcctatctcgtcaagatcagggcaaaaggaagaaaacaccgaattctgcttgccgtttcagagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaattaaaaaaaaagaaaagaaatgtgtcttaacatttccaggtatgtgttgtattgaaattgatcagctaaattttacgggtgctggagactggaaaaagcatccagtttggttgctgtggagcaacatgcatattggattagaaaattgtgccaaaaactcccactgatgagaattcataggtgccccacactatgacaaacacttatatgattctcctctttcctg

SEQ ID NO: 7999 - DNA, 2770 bp, Homo sapiens
  ENST00000356504
aaacgcgtcgtttcgcagcacttgatcggaacccggctgcctctaagacttggtcttgggcaaccgtgggtgggcaggaagggaaattatttattttattttgttaaggggagtgaagaaaagaagacgtgaggaccgcagttcactgtaatgtagagtaattgcaaaagtgggctgcctgcccctagcttttcccgctgtggttgcggaggtggtcttggttgagggggttgtggcgtgaagtacccatctctcctctcctctcctttcctcccctcccctccaacccattccctttccagctgctatgccagtttaaagtccagggtgttattattacgtgtgcgcaaaacagtgtttgctgacgatgaggctgggggacgttcctggcagagagaagtctgattacttggtcatcttgctgttaaagaaagaaagaaagaaaaaaagaaagaaagaaacagaaaggaaaagggtgggggtgggggtccataaaaaagaaatcgtctctcaatcatcaagtcctacacagagtccaggaagtaatctccatagctttaacacgaatccctaactaaaaggatattctttggggttacttggatagtgaaactgaaggcaattttaagtgtattttgtttttcattccatggctttgtaaagagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaatt

SEQ ID NO: 8000 - DNA, 2273 bp, Homo sapiens
  ENST00000630416
tcgtcaagatcagggcaaaaggaagaaaacaccgaattctgcttgccgtttcagagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggaggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagtccccttcaataaaagctgaaggcattacattaacatacaactcagtgaaagcaattcttcaaggagctaagctaatatggtccaagtatatagctttctcatggcccagtttattccaagaaaagactttagagtacttagagaagtggatggactgtttaaccttcaaacaatcttctaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaatt

SEQ ID NO: 8001 - DNA, 1155 bp, Homo sapiens
  ENST00000510233
ggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatct

SEQ ID NO: 8002 - DNA, 1562 bp, Homo sapiens
  ENST00000507069
ggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagtccccttcaataaaagctgaaggcattacattaacatacaactcagtgaaagcaattcttcaaggagctaagctaatatggtccaagtatatagctttctcatggcccagtttattccaagaaaagactttagagtacttagagaagtggatggactgtttaaccttcaaacaatcttctaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatct

SEQ ID NO: 8003 - DNA, 1017 bp, Homo sapiens
  ENST00000513005
ggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggaggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctgagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatct

SEQ ID NO: 8004 - DNA, 2366 bp, Homo sapiens
  ENST00000515082
aagcggcctcggggagcagcccgaggctgcgcgtgggctccgctcctccggcgaggtgtgggcgaggggagcggcgctccgagcgcacccaggcgcccgacgccgcccgggtctgcgccgctgctagtgccaggcgggcgacgagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaaggtaagtgagagcttccgtgttatcattattaagaaaataccctaatgaattccgcttgtaacagatatgtttctaaaaactgacattaaagacatccatatatatatgaatttgaatcatatcaatttcttttaaagtgttcttgcctgaaatcctttaggagttcttgtagtactaatacttccattaaaaccactccgtagcatctgttgagctgtatgtgtcaggcactgtgctaagtgttttacatatgctctctcacataatctttatagcatccttatgactagactgccttcttattcttatttttactcatgaagaatctgaagcagtaaagttattttcttgcccaagcttacacaacttgttagtaagtatacttgaactccgatctacctgtctgactgttaagttcatggttttaacaccacactgcattattataaagagattagaaaaagaaaatgggcattaattttacttattatagaattccaggctctatcaatgaattgaatcctcttcacctgttccagtctctgctgattgattgtaaaagcccggatagcatttttttaaaatctttcccatgttgtatggaataaatatgtcggtgctggaatgcttaggaattttaaattgttcatatggtctaaaagggaaaagttatttgtttttaagattaacttcttttgagattattgctgtccatatttaggtttcaagtactgaatctaatgggagatttgtgcattgatataacagctgtttcctttcatactctgtagattatgtatctgcctaagaggaggctttgaatgtatcataatcatctatattcttaataatggtaaaaagttgtattcagaggatatctttaacattgtatcaacctaaatgcttcttttattaaatttggattaacatacttgcagatttgatttctttttcagttatttgaatatattttttcatttctatgaccatgttacagtttaaatatacaagcagtaaatgttatagtttaaaagtcttggtctttttccttaattttgtaagccatagaaattttaataagactgattatttatttcattttataagttgtgttttccctactaacggagccaacaaataaatattaaaaggaa

SEQ ID NO: 8005 - DNA, 605 bp, Homo sapiens
  ENST00000514236
tccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggtgagtgaatacacactttgcagtacagcacattatgtttcatagcatactttcaaaaacattatctctcttgatcctcaaactaattatttgtagtaggtggggcggggagtattgtttttgccttataggtgaagaagtaggctcagagtggtaacatagtgctacactgttaataagggatataaggaaagaaaagtactcaaatattcttaaaacacacttagtcttctttctgttaaatcatactgctgttcaacatttgtctgtactatatttacacaaggagaattttcttagaagttttaatttatagtctcactaccatatttctaggctttctatatttttctgttgtttttagatgaagagtgatgatcttaaaactttaagttagaaacaggtagaaagggagggaggaagagagacctcattcactttt

SEQ ID NO: 8006 - DNA, 574 bp, Homo sapiens
  ENST00000514193
tcgtcaagatcagggcaaaaggaagaaaacaccgaattctgcttgccgtttcagagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggaggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcaga

SEQ ID NO: 8007 - DNA, 596 bp, Homo sapiens
  ENST00000503806
agcacttgatcggaacccggctgcctctaagacttggtcttgggcaaccgtgggtgggcaggaagggaaattatttattttattttgttaaggggagtgaagaaaagaagacgtgaggaccgcagttcactagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgg

SEQ ID NO: 8008 - DNA, 582 bp, Homo sapiens
  ENST00000506961
gtcaaacgcgtcgtttcgcagcacttgatcggaacccggctgcctctaagacttggtcttgggcaaccgtgggtgggcaggaagggaaattatttattttattttgttaaggggagtgaagaaaagaagacgtgaggaccgcagttcactgtaatgtagaagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcata

SEQ ID NO: 8009 - DNA, 5812 bp, Homo sapiens
  ENST00000507460
atttgcaactacaataaaatccaggacacctgctcggcagcacgttagcctggctcttttatagtcttcaactttgctcactgtgattaccgctgcctgcctggctggtgtttgctgccggagcctcacgcgccttctcttattgtgatcctcggctccagagcagctgtcaaacgcgtcgtttcgcagcacttgatcggaacccggctgcctctaagacttggtcttgggcaaccgtgggtgggcaggaagggaaattatttattttattttgttaaggggagtgaagaaaagaagacgtgaggaccgcagttcactgtaatagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagtttccagagtggaatctccagtctgtgtaacatagccttcaagagccagaacaaagggacccaaactcaaatgctctccatgggcagaacaaataaaggaatgagtggagcataatggagattgaagaactggagagcacatttcttgtatgaagggggttgagttttatctgatcattgccacataagtatttaaaatcagagttgccagatattccaattatttttcaaaagttgttgaagatctccatttttatagaaagttttcttcagtcttaaaggtcaaccaattttcatttaaatcaaactaaacaaaatctgtgcttcccaaacaaatcacacttgagtattagtttgcagcctctggccctaaaccaagacttctcataaagggtatgaaaaaaccagtcggaaaacttgttaagtgcaaatttaacaaatcttcaaagactcattcagatttggtttggtcccagaactatatttcaacaaatgttcttgattctgatgcacatggtccaaacactggactgagtcatctgttttcaaggttctggttaaaaatgatggtttctttcttctttctctcatagtactttatttgaactcttttaagttaaagggaaaaagaaatgtgtatggtaagattggtctgttaccagatgagtctagctagcattttcctcaaaacctcaaagagaggcctctgtcccccattgttctgaggtggctgtcagtgttacaaggtcagagtcctacttttgtttagtgattggattagtcagaattaactggcttatgtttcagtaataactatccagttttatctctcgatcatgtatcttgctcacgatccaaccttgtccactgaggttggatggcatgtaggaatgggctctcttttatgtcttcctcacttagggtttcggattgatggacttccaccacctaaaacattgctagccactgtgtccaggggaaagatgtggctaggtgtacactgtcatttaaagcttctgcccagatgtgacacaatgtccctctgcccacagtccattgttcaaaggaaaccatatacacatgtttaacttcaaggtggcagggaagtgcaaccctaccatttactcagaagtggaagaactagcaatattttgcaagtaacttaataactaccacacttggcaagtagaacccatttctcagggtgcaagtcatcttccatagtgactgattatacaaactgtttggtgacacaggtcatatctcatttcaagatgtataattctgcaactttgttttgtctgtagcatgcatagaatgtttatgaagttaattattatgaagatatgatattaataaccatgcttttttggatatagtcaactttatgtaccttctcttttcttggtgttagaaggcagtgctgtatgccctttttccaaagctcccaggaataaagaggtttgccatttgtgctgtgaaggcatagttccagttgaagatatttaaaaagagatactctttgaagtgttagtctgaaatttcaacctccgtgacagtaattgccagggagaatggagttagataggtgaggaagagaccatgtgtggtttgctactgtgtccttagtgcttggcacagtatgtagaattcaccatttgtcaattgattatgtgaatccaacactcatatatgcaaaaacagacatatctgtgctttggagagctacttattttgggttcttagaaatgtttttgacattcaacaatcaatttttttctatatattttagtggtttagacttctgacattgctaacaacgagtcatccttctcagaaacaatgttgattgatagatgggttaaattggtctgctgaaccttaaattcagtagcacataaaattagaaccattgggttgaacctggatttaatatagtgaaatggactaattcagtagcccctgctgttactgcttttcagaccatctgagcagtgatcatgaacaaaggctctatggcttcagtcatctgtaatgcatacaacactgccttctaaccccacaacaaaagctttggaagagccactagatgcacatgatagagacaaaaacaagaactacaaaaatgtattttaaaagcctgaaaagcataagcctaaaatgtctctgtattttgagattttgcaaaactattgttagttttataccaaccgtttaaagtttttcagttgtcttgcagaggctgttaatgaaaagttataagataatggaatcatactaaattataatttctaacaggttctgagattgaggtgccatgctaagcactttacatatcatttaatactcattataactcccatgagatagataaattgatgacccctaccttagaagcaaggaaatgagagccgcagaccaattacttgccttttgtcacctaattattttgtgatggcatggatattctatccaatataattttctcaagagcctttctccagagtctcatcaatcaggaattaagcaccctcaaatcaaacaaaggtggtatcaatgagtatatgtatgctttggaggaggagctcactatttgttacatttgtgtaatcattagcatctggataagtatctctggaaggggaaggatggtgcgcagtttcattcttttatttgtttaggtgttcttattattgcatttcttggtcatcctgagtttgacgtatatccagacttgaatacaggtttagacatgaaggatcagaaaggacagtgcagtgtttagcagaaaatctattagggtgttgtgaattaaagccagaatctgttactctcactgctgattttactcccttactgtgtgaatcagagcttttggtattattatgctggagaatagctaatgagaaggagataagaagaccatgtagtctagatagataatctcagcatttcttggtacaaagtacattggtacttgagttatttgtaaaattagtaatacaatgatgcaattgttcatataaatttcaatcatgttaagcttattataagtgatattgaagtaatatgatacatgaagaagggatgagtatatgaaaggcaaatagatgaaggcatattaaatgcaagaaccctctttccagatgcattgagttacaactgcttcatttccctttgttcccatttgacccatgtacatcttatgagacacaatatagtgtactttggaaaagatcaggctttggagcttgaaaaaccagggtttgtattctggtttgagcatgttcttaccatgtgctttttgtatacatgaattgccttctctaaacctcagtttcttcatcagtaaaataagtataaaataactaacatttatagcaaggttacaaagagtaatgaaattatttgtaatgttcctgtaaaagtacccagcatatgttgggtgttcattagtggccaacttcccatgtgccttttgatttttgcgaacatgtcataatgtggagatttgttcacaatttaggaaataatgagtgaaaatgagagaacatctaaaaataggacatgagatagttatttttactaagagagttcatggagtttgatagtctttatttaactgtgtatcctagggttacatgtgattaaatttttcctttgtgggatgccctttaagtagaagtttattgcaaaattctccatagaatgtttaaatttcatggtatttcttgtcatacactagaattaaatgagaaggaatagttggattttgagattacatctatggaagtacagaaccaaacaggagaataaggtgtttctgagaaaacctgagcagtcaaataaatgatagcttaacttcatctggcttttctttagaaatttagacttccataaatatgttgtatttcccttgcataaatattagccattagtgatctaattacctgttagatttctaatcatgattacttatgatttcttcaaaacttaaaaaaggtaaccttttaaaatgattgaaagtgttatgcaatagacaatttttaaaacatttactgaaatgagtaggagatagaattctaggctatccccaaatttcttgtcacatgttttacatgccctgtatgatttctgtgactgtgactgtgatttcagtctgatgattagtttttgttatatggcacagttgactttaagaaagggacattatccgagtgggtctgacctaatcacatgagccttttaaatctaaatcaagagatcagagacagaaaagtccaggatatttaaaacatgagggagattcttcattgctggtagggggccacatggcaaggaacacaacagcctctaggagatgagacttgacagccagcagggaaaatgggaatcttaattctacagctgcaaggaactagatttggacaacaatctgaaagagcttagaagctgattcttccccagaggctccagaaaggagcacagcacacccataccttgatttcagccatgtgagaatctgagcagagaaccaagacatagcatgctggacttctgacctacagaactatgtgctaataaatgggtattgtcttacattgttaagtttgtaataatttgttaaacaatagaaaactagcatatctactgttactaattttttaaaatacatttttcagtgtttaacctgtgctaggcatagtgtactttacacctaccatctcatttaattatttcaaagtactgtaagataggcattataagccacatttaacagataagaatatcgaagcacatataagttaagtaatatgcatagggtcacaaattattagtgtataactctgaattgaatttagatctctttgattccaaggcttgggatcttacatgcccctttattaggtaggaatagatacttcatgaagatgataacatgccatctacagaatacgatatggcattgatgtgacactttacctacaaaatatcttatttctgagtcttccgcaagagaaaaagcaattttatttttatgggacaagattggatgttacatttttaatcaattacatgtaagtgtattctacctttaaaattgctatggaaaagtttaattatttccaacaggatttataactatcagttatacctcaaagttgttattaactgaataaaactacacattccaaaatgattaactcttaaagcgcattattggtacattcataatgtttaattttatttttatcatccttgctcatattgaataaatgccttttaaaacca

SEQ ID NO: 8010 - DNA, 363 bp, Homo sapiens
  ENST00000509716
ggcggtgatgaagacaaaattgaacatctacaacatgcagttcctgctttttgttttcttggtgtgggaccctgccagagaccaatcaggaagaactaggctctaaggatctctgcagctgtgtatgtgttgctgatgctttcagagcccacctccacctcctggctacatggagcctggcacatagccagtggagtttccctgatgcttatattgcacttggccattgggtggaggtatacccaaagttggtgctggctaacatccaagaagatgaggctaaaaataacattaccatctttacgagaattcttgacagacttctggatggttacgataatcggcttagaccaggactgggag

SEQ ID NO: 8011 - DNA, 2588 bp, Homo sapiens
  ENST00000540012
atcgttttccccctcctcctcttcctcctcctcctcttcctcctcctccgcccatcaccgccactacgaacgccttcgcctccttctacacctcgcgccgccgccgcggctcctagcgctcctctccggcttccaccagcccatcgctccacgctctcttggctgctgcagtctcggtctctctctctctctctctctctctctctctctctctctctctctctctctctctctctcccaagtttcctatctcgtcaagatcagggcaaaaggaagaaaacaccgaattctgcttgccgtttcagagcggcggtgatgaagacaaaattgaacatctacaacatgcagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaaaaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagtccccttcaataaaagctgaaggcattacattaacatacaactcagtgaaagcaattcttcaaggagctaagctaatatggtccaagtatatagctttctcatggcccagtttattccaagaaaagactttagagtacttagagaagtggatggactgtttaaccttcaaacaatcttctaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactacctt

SEQ ID NO: 8012 - DNA, 11973 bp, Homo sapiens
  ENST00000264318
agtcaacctctggaagtaagtcaactccattctgaaaaagaagagtgtcgcaagaagtgaaagtgattttgaccagaggtcgcttgtctccacctctcccctcctctccagaaaaggatggagcagcaaagcggagggtgtgcgcgtgtctggtggaggcgggtaaagaaatggggtgtctttaaagcaatagcttagcaaatactgggactagagtgcggctcgagtccacttcccaatagtttggcgagagtccgccgggtgagctgcaacccctgttaccaggaagaatctttctgctttcattgctctccctaccgccccccataacacctgaatgggagggtctcaaaggtggtttgagcccggacttgatcccctctcctcaccaccgctaccacccgacgcccagcagtccccgtcacccgccctttctccacctccaaccttgactctgggtacaaacaggtcctcgcacaacctgatgacagaggagcttcattggttagatccaaatcccagcggaagggagggggccaggaggtaggaggacgaacactgctgtgggcggggagcccacttggggtcgggggctgcgaagccggaggaggggcgagagaccccgttcctcatccccggagttacagtcggaacaaacttgccgagtcttgcagcgcaagcgcgcggatacgaaccccagaaccttcagcgcgcgggcacgaaagggtgtggagcggtatacatagctctacatacacattgagcgctgagcgagaaaggagggggcgaggaaggcaggttccgcctcccctggccccgtgcacacacacgcccaccgcggctcgggctggctgagcgcgggcgagtgtgagcgcgagtgtgcgcacgccgcgggagcctctctgccctctcctcgcaccctgctcagggcatctgaagagcctggaaacgtgaacaggcttgaagtatggcatgttgcaaagatggtttctgccaagaaggtacccgcgatcgctctgtccgccggggtcagtttcgccctcctgcgcttcctgtgcctggcggtttgtttaaacgaatccccaggacagaaccaaaaggaggagaaattgtgcacagaaaatttcacccgcatcctggacagtttgctcgatggttatgacaacaggctgcgtcctggatttgggggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggtgaatatattgttatgacggtttacttccacctcagacggaagatgggttattttatgattcagacctatattccgtgcattatgacagtgattctttctcaagtttcattttggataaataaagaatcagttcccgctaggactgtatttggaataacaactgtcctcaccatgaccacactaagcatcagtgcacgacattctttgcccaaagtgtcctatgctaccgccatggactggttcatagctgtctgctttgcttttgtattttcggcccttatcgagtttgctgctgtcaactatttcaccaatattcaaatggaaaaagccaaaaggaagacatcaaagccccctcaggaagttcccgctgctccagtgcagagagagaagcatcctgaagcccctctgcagaatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtaatttcgttgctatagtagtttgctaaaagatgatgaaaatgcagaatgtctttttaaatgtttttaaatataaacaaatattctttactaaaataaaaactctgtgtaatttttccatttaaagatataagccagttattgggagagttaattaattcctgagtgaaaaagtgaactatgttttttttcagaaaaattattttaaaagaactcagcattcagttagatagaatacacaccatcctggaaagttgggataagagaaatagagctattagagacaagtggcgcatattttttcattgatatttgaaaacagactatgacattttaaaaatctgccctatgagtatcaacctgccaccctaaatttcccagtggcactacccttaaccagaattgtttattagatgtcatatgcagtgacctttggtgatcttcttaggaacttcaagaaaaggaattttcctgttaaattaaacattggcaaaaggaaatggaatagtataaacactgatcaatagagtaaaatatctgctgcataaaaaactaagacaaagaccagaggaaatatcttccctttcttatgttggctaaacagtacttaacagttgacttgaaattttgttctctgagccaaagtttaactcattgtatgaattctttttcatggtagttcattcagttatgtgtttatttactacatagttattcagagcctactgtgttccaggaactatgctagaaactgtctctctaggaaagctcttgcacctttatctacaatattacttaaaaagtagaacagtcaatgcatgccaaagaaccataaactagcagaggacattgcattctttagtgaaggacatttatttagagtctgacaacatattcaaaatatttttcagcctctactgatagtggataacaaatatatttgttcacataaccactttgatgtcagtacaacttcagcaattggttttcaaaatagatgagaatatggtacagattgttctataagtgaaaagcattatgtacttgaaagtaaaaatcagggcaatataagacttaatagattaactgtcgcaaatttgatcagagtcacagagtagaatttgatcagaatcacagaatcatcagacataggaactgagcacaggctttttcaggtgctttccccaagatagatctagatattagctagtgaaatgctaaattttgaagagttttgtgtccgtagttctgtaattctgggcagtcatcatgttggtttttttgggagtttttttaaggtttaataactaaggggaatattttaaaattaagagagcagcaaatgaaaggagtaaagaaaaaaatagctgtcgggtaggatgccactgactctgctatgtgatttatcagggttttcatctactgacttctttctcattaggtaggcttaacaacttacttgagaattttgcaactgtctatgcagctgaatctaagtatggttttttgtcatattgcctctagattttcttctgtgcttctctctatctgctctggaatggatgagtgaatgtgttctgggtgttttagggaacatattgatagaaatgaccaccttgcagacaaaatctctctctctctttttgtttttatagaaaagaagtgatagtagttaattggcatcgatttttcagatattgcactaccttataatggttgtttttgatacctgaaaattgtgcaaatgccaaatattaattgtaagtcatatctgagaaatcattcttggctgtctttctaggtattccatagaatcaacacattttaaggctgaaagatactgtcgaaatcacccagtcccaaccccccaatttaaaattgattctagtaaaattaggtccagtaacacctgtatatatgtatatatttaataaagagtacttgtacaaaaaagcttatcataaattatttcatgaatgtgaatagatttctggccttgaggacgatgtttggaaatatggttggaagcacaattcattcgctactagttattcagagcgtactttgttccaggaactatgctggaaactgatagttcactattctgatgaaaaggctggttttgttgttgttgttgttgttgttgttgttgtttttggtgaggaactcttactctttgctaatctattggcctatcttaagaaataattatttggttattcattggcttcctttaaaaaaaagtgttcttctacaaatcttacagagtgtaaagagataaaaagaaatgattttttttcttacctttacatatgaaggtttaaaaatacatcatgtggccaaagaatgagaaaggacagaattaaccaaggattcttaattgttaatttgaagaacacattaaccagaaagcttaaacattattattaaaataaattatttcatttgcacacaatgataataatgatgataataataataataataataataataataataataataataatatgttgtttgctttccttaactgaatttcatcaaattcattcagtgatttttattttggtcattatttctatcttcccaataacccagaggtacatcaagtaaaaacacttttgcaaagagccagtcacttttccctcttagaaaatctcagaagaatgattaggggcacccaaagttctggttatctatgaataataatgaataattttggctgagaatggtacctttatataactcttttaaagatgaaattcagaataattttattcaggacctagtatctgcagtccatgttggccactaactgctacataattactttcaatttcctccaggcatgactaggtataaacatatatttacatgattaatccacattttaaaatgacttgcacttgtgcatatacatagtactttgaataatgtatattttaaattggacctcacaaatcttgtattaaagtaggtagagagtagagtcacactttttttgatgaaatgagtcacagagaagttacatgacaaagataaaatcacagggttggaaagaactttgaaaggtcatttttcaataatctcaccttaaaagtgaccccttttcaaacaaagcataaacaatttatttgtggcttattttacccatgagctggccaatacttcctggcctagaaaaatatctccactctccccattcctgttcttaatggtcttctcttctcaatttgtaaatattctccagtaaaagacaccaggtgtggagatgggtcacttaatttcaagttctgagtgtcttgtggttttaaacaagtctcttaacctctctaagactgattcctcatttataacagggaggaggtggattatgtaatatctaagagcttttcagttttaatactctctgattctcatagtaaatacaagcatactcttgtaagaaaaacactgaatactttgaaccacaaataagtgtttatggacaaaaatttagttctactgcttgattactttaagttcattgcttgcttcaaactaaggtttccctaccttcaaaaatatatataacatctctccatttagataaagtatattcttccccagggaagactgtattctttaaagacagtagaatattggctatttctcttttctgggatttcctgggcttttattcactaaatgggctcctgcccagtttgggtactgtgctgatttttagatatacagagataaaaatagcccctttccttgcaggtagtcacagtccggaagagatgatagatgcatagacaaaaaattatgggatgtaactaatgcttcagtagaatacagcagggccaaaactagagtgatactcatctcaggcacaaatatatatggggacatcaaaacttcaataatcaagatacctaatatttaagtgaatatttttaaaactcaaaattaatgcaaaagatttatgatgaacagaatatacaaattttaaataaattaatagaatcagtagtaataatattttcttctgcctcaggctccaaaattgctcagcatagcactgatctagatagaggtggataaaagatccacataacttaattacattgttgaaggagaggaacaagagtgatagcagagaaggtttcacagatataatcttaagctaaattttatagaatgatttggagttcttatagcctccattcccacttccacaaacaaacaaaaaaatgaaagcgcaattttatcagcacctgaggcaggagaagagatgaggatgtggaaagtcaaggggaactcttactacaaattcttagttctgtgtttggaggtaagggtgaatgcagggaagtgagagttgttgatgttggaaagacctaaagagcctggattaggaagagttttgtgtaaattactgaaggaatggaatttgatcaggattagtggcaatttattaaaaatcttgaagaataatacgatgaaaactaacatccttatttttctgttttagagaaagcacctgattattgtgtgaactatggtttggagggccacaaatctagaggtagtggaacagttgagatctcttattttttctttcctgtcttaaactttgccttctattccttttttctttttttgaccgcaatgacttcattgtcatttgtaaaagtgatacatgactgttaaagatagacattgtagaaacttaaaaacaatctcaaaattctaccacccagaaatcagaaatattttgtatttggatatgtttgtctagaagagtagattgcttgattaaaagacagagttttataaatgtagaagccaatatgacatacatgctgccattaaataataaaaaattaaattgacttttatctcaagataagattaaaattggagggtaaaactgaagaaattgttgaaatttggatggtgcttctttaaagcaagagatttagagagtcagagctttttatcccaggtttcaatctttatttcaggaaaattttctgcaattttgtctaagttaattttttttttttaagaaatgccaattatgtcaaatcccttttgtctctatacaatagtccccaactgttttggcaacaggcacgggtgagggtgggggaatggttttcagatgaaattgttccatctcagatcatcaggcattagtcgattctcataaggagcggacaaccttgcatgccctcctatgagaatctaatgccgccgctaatctgacaggaggcagagctcaggcgataatgctcaatgggtgccactcacctcctgttgtgctgcccaattcctaacaggtcatggataagtactggtcagtggcccaggggttggggaccactgctctgtaactatttacagtattctttgtaactactttggtatctttaaaattttctttaacttttgtcaaccataaccctagtgagttttcagttgtgattattctattttgtaacttccaatgtacttttcaacttcataatggttaattttgttttccattgctttcttggtcactgtcatttcatttttcttctctttctctatttttaccattgctttattgaaatatcttctttgagcttctcatgtttctctattaatgagatcatgtctataatattttttgagactacagagacctatttatataaactcttcctctatttcttgaaaaagtttttatctggcgtgagcttcatctgctttttcattgaggttttatctcccttgcctatttttggggctggtttctttctattaatcactgagcagagccagctatttactgaactacagtgtgggaagtggtgggagggtgagtcagatcagcccacagaagctatttaaatttcaggtttcaagcccacctccccaaaaccgttttatgtgttttttcttctgcccaggcaccatatttttatatctatttttgacatttgggcggcctatgtagttcacagtgtaaaactctctgttttactttctttatgttattgctagtgattattgcttgtagtcccacccccttccccacattagccttagtattctatattattcagcaagcttgttcacaactctcaaatatagtctatcagaatttttatctttacctctacattccactattcggaagtatatagtaaaatcgtatgaagacagattttgtctttttcttgcctgtttacactctatcttacagaggtttcaaacaaaccatctttgtttgaaacatcgcaggataatgatacttattgaaatctacatcctgcccaagatatatgccagtcaatttcctttctcctattagtgcaaatggctacctacttaaaagctgctgactatagtttgtcatcaattacttgttaattacagatatggttttcatttttttttctcaatttttcattatgttatttttggagactgtcttaggtggggagtgaattataaatatttttatttcaccacctttaactgagtcaccatatgttatttgcacttccaatagaccagggattgaccagagtatcttttactgatatgaccaccagagctacatggcttttaccttctgtatatcagatgtcactggaatcaagcattaaacctagattaaatctggattaaaccagctgtatggcaccttagaaaattgagaaggactaggaagctgatagaaagaactcctgtataaaaaataaattctttttacattttccttggtagtatttctgcaagcttctttagtttctataggggaatcccagagttttcctctgagattgcttccctttcctttgtattttcatttttccctcttgggctttacttttcagtcgtgtatttctatcccaatgttaatttattacactgtttatattttcctgtccttcaattcatcagtagattagtgaagtacttattcctttaattataagtataaacgtttttaatttctttttggataacgatacatttaatggaaaatttttaaatgctatggtttcttaatagcttttctctaccactaattacttccgttaaaaaaaaaaagaaatacccatgcgtaatataaaagaaattttgaataaaatgttatcctttccttttactagagacaaacatctccacttcaaaatggaaaaatggaactatgcaaaggaaatttacgatattcaagagtatgatattatcactgaaccgattaatttaattgaaaatactaacctgcaaaaaagaattacacaaatgtatttgaaatgtcatcagatacctcaagctatgacagagttgattatgttacacaagtagtaaaggataaattaaatatattctatattaacactaagatttaaaactaattatagtcttctttaatttttctactgtatacatttcatctagttttcagtaaaacaaacttttcattacttttacttatcccatgcaaatctagttgctataagatataacctaatttggaaatacctccctgtaatacattggaattttggtgtgagtgtgtgtgatcagagaggataaacaaatggtgtcagcaaaatagaatgtaaaatatggagataatgtggatttacacaatttgataaaaattctcccttgaattttgcagatcatatatgaatatcatcatgtgaagtgcaattaggattttttcatatattaatacatatacatcatctctttaataaaatattttgctgaactcgtttaatatttctcatgtctcatatttcatattttctcatatgtctcatattttatattttctcatatgtgtctcatttttattattactatagtatccattaaaggagactggcaaatacctgaacaaagttatgttgttggcaatataagatattaccaattgcataatattatttccaaaggcaaattaatatgcaaactatagatttccatgggtatctatacaaattattacttgaagtccatagaaaacagcttccttagagggaagtaaaagaagctctgataacagacaatgtatagcatttcagttaaagtttgattgacatatttttttctcagtcttttatacttgtgaattatagtctacattttgtctttacagatgttgctaacacagtgcagcatgttggcttgtcattttactgattatgtatattgtctcctagttcaagtatacagtaaatcagagctttcatttttcaaggggcagaaaaataattgttggttgataaggtaaggttatatgattttgagggagcttcattgtaaattgaatgagaatccggttttcatgcaaaggtgtatctatgcgataatactttgaatgtctgtagtttgaaatagaaggttaattttttccactggcttatccttaatgaaggaaatcccctgataattactttgattctgaaaatgttgaaaactccagaagaaataaagcttttctttgatttctcagctgaagtgttgtacaaactgaggaatatgaagtccattcccttctttcttctcttgaataattttaaaattgtttgtttagttgtacaattgaaaatattccttattatagaagtaaaaaaacaataatgcatatttcctcatatcataaaaactaaatttgttatcatctgagcttcaatattcttgctcaattagaatagtaaatataaagtgtgatatttataacagttcaaggtttgataggagatagaggtgttttgattttatgggaaaattacttcctcaagaacacatttcttgaggttttagtaatcacatttgactccctgaaattggcaattttattcaatgtaggaatattatcatggtatattatagtgaggagcacatagtcattattattttgtttttgcaaatttattttgaaaaaaaggagcattatcaaatattggtttactattttaaagtaattcatcaggaaatgattttttaaacactgtccctttaagtaaatgtcccttgcttttcaaagctcaacttattacttatggtaatagagttactttgcttcttaaaacaaagtttatactagagcatagcattgtagaattattcaggtctcaatttctcactggaaaatgagtctttaaaatagtaaggatttaaatttctataaaatttaatcacagatacttatattttaagataaatgtgttggagctaaactctggaattattaaaatataaaacattatatccctctaatgtattttttctatttaaatttaaaacaataaacataaatatctttggaa

SEQ ID NO: 8013 - DNA, 1623 bp, Homo sapiens
  ENST00000511523
ctgccctctcctcgcaccctgctcagggcatctgaagagcctggaaacgtgaacaggcttgaagtatggcatgttgcaaagatggtttctgccaagaagtttaaacgaatccccaggacagaaccaaaaggaggagaaattgtgcacagaaaatttcacccgcatcctggacagtttgctcgatggttatgacaacaggctgcgtcctggatttgggggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggaataacaactgtcctcaccatgaccacactaagcatcagtgcacgacattctttgcccaaagtgtcctatgctaccgccatggactggttcatagctgtctgctttgcttttgtattttcggcccttatcgagtttgctgctgtcaactatttcaccaatattcaaatggaaaaagccaaaaggaagacatcaaagccccctcaggaagttcccgctgctccagtgcagagagagaagcatcctgaagcccctctgcagaatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtaatttcgttgctatagtagtttgctaaaagatgatgaaaatgcagaatgtctttttaaatgtttttaaatataaacaaatattctttactaaaataaaaa

SEQ ID NO: 8014 - DNA, 1776 bp, Homo sapiens
  ENST00000508560
ctgccctctcctcgcaccctgctcagggcatctgaagagcctggaaacgtgaacaggcttgaagtatggcatgttgcaaagatggtttctgccaagaagtttaaacgaatccccaggacagaaccaaaaggaggagaaattgtgcacagaaaatttcacccgcatcctggacagtttgctcgatggttatgacaacaggctgcgtcctggatttgggggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggtgaatatattgttatgacggtttacttccacctcagacggaagatgggttattttatgattcagacctatattccgtgcattatgacagtgattctttctcaagtttcattttggataaataaagaatcagttcccgctaggactgtatttggaataacaactgtcctcaccatgaccacactaagcatcagtgcacgacattctttgcccaaagtgtcctatgctaccgccatggactggttcatagctgtctgctttgcttttgtattttcggcccttatcgagtttgctgctgtcaactatttcaccaatattcaaatggaaaaagccaaaaggaagacatcaaagccccctcaggaagttcccgctgctccagtgcagagagagaagcatcctgaagcccctctgcagaatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtaatttcgttgctatagtagtttgctaaaagatgatgaaaatgcagaatgtctttttaaatgtttttaaatataaacaaatattctttactaaaataaaaa

SEQ ID NO: 8015 - DNA, 871 bp, Homo sapiens
  ENST00000502874
gtgagcgcgagtgtgcgcacgccgcgggagcctctctgccctctcctcgcaccctgctcagggcatctgaagagcctggaaacgtgaacaggcttgaagtatggcatgttgcaaagatggtttctgccaagaaggtacccgcgatcgctctgtccgccggggtcagtttcgccctcctgcgcttcctgtgcctggcggtttggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggtgaatatattgttatgacggtttacttccacctcagacggaagatgggttattttatgattcagacctatattccgtgcattatgacagtgattctttctcaagtttcattttggataaataaagaatcagttcccgctaggactgtatttg

SEQ ID NO: 8016 - DNA, 487 bp, Homo sapiens
  ENST00000509316
gggcgagtgtgagcgcgagtgtgcgcacgccgcgggagcctctctgccctctcctcgcaccctgctcagggcatctgaagagcctggaaacgtgaacaggcttgaagtatggcatgttgcaaagatggtttctgccaagaaggtacccgcgatcgctctgtccgccggggtcagtttcgccctcctgcgcttcctgtgcctggcggtttgtttaaacgaatccccaggacagaaccaaaaggaggagaaattgtgcacagaaaatttcacccgcatcctggacagtttgctcgatggttatgacaacaggctgcgtcctggatttgggggtatgaacgatttcaaacgcgcaagtgtgtcctgtctgtccctctcttggtcttcctgtctgtctgtctgtgggaatatcattaggtatgcctcacgtgcaaaaataaatctctctctctttctatctctcctctcttggtgagacctatgacaagaa

SEQ ID NO: 8017 - DNA, 584 bp, Homo sapiens
  ENST00000522269
gaggagagcaggtgtggcgtgccagcggaagataggtgccgacagggccttactctgtcactcaggctggatggagtgcagtggcacgatcatcactgcaaccttgaccttctgggctctgatgaccctcccacctcagccacttgagcagctgggaccacagcccactgagaccaaagtccatgtggtcagacacaaaagagccatcgattgctgaacctgttcactcctaccttcaaaggcacaaaaagaacacaggaagtcaatataaagcaggctcataggtggaagggacttgccttgtctcagatgagacttcggattggacttttgggttaatgctgtaatgaggctagaaaatgccctagggaaactcgaagttgaaggcaacttctactcagaaaacgtcagtcggatcctggacaacttgcttgaaggctatgacaatcggctgcggccgggatttggaggtgctgtcactgaagtcaaaacagacatttatgtgaccagttttgggcccgtgtcagatgtggagatggagtatacgatggatgtttttttccgccagacctggactgatgaga

SEQ ID NO: 8018 - DNA, 565 bp, Homo sapiens
  ENST00000518888
actcaggctggatggagtgcagtggcacgatcatcactgcaaccttgaccttctgggctctgatgaccctcccacctcagccacttgagcagctgggaccacagcccactgagaccaaagtccatgtggtcagacacaaaagagccatcgattgctgaacctgttcactcctaccttcaaaggcacaaaaagaacacaggaagtcaatataaagcaggctcataggtggaagggacttgccttgtctcagatgagacttcggattggacttttgggttaatgctgtaatgagactctcctttcccaactgagtcagtcagaggagcctgggtgtctgcaggacataatctaagaccacaaaccaccttgttccacgtgagaaggaaacaagaaagaagggagccaggggaatcctgcaaatttttaggcaacctctttatctattggattactgacttgaggcaaacaaggaacagagatatgaagggtttgaaagatttctccagttgattggcagagaagagctggctagcagggaggacgaccctaggagggtgaattctgc

SEQ ID NO: 8019 - DNA, 2128 bp, Homo sapiens
  ENST00000274545
aagatgccaatgctttccagatttcctcacagggccctgctaattccatgccaaaactggcagtggatttcttccttctaatctcccttaatgccttattcgattattgtcactgctctccgaccatgcactgtcccttcagactctcctttcccaactgagtcagtcagaggagcctgggtgtctgcaggacataatctaagaccacaaaccaccttgttccacgtgagaaggaaacaagaaagaagggagccaggggaatcctgcaaatttttaggcaacctctttatctattggattactgacttgaggcaaacaaggaacagagatatgaagggtttgaaagatttctccagttgattggcagagaagagctggctagcagggaggacgaccctaggagggtgaattctgcatttcagtgcactgcaggatggcgtcgtctctgccctggctgtgcattattctgtggctagaaaatgccctagggaaactcgaagttgaaggcaacttctactcagaaaacgtcagtcggatcctggacaacttgcttgaaggctatgacaatcggctgcggccgggatttggaggtgctgtcactgaagtcaaaacagacatttatgtgaccagttttgggcccgtgtcagatgtggagatggagtatacgatggatgtttttttccgccagacctggactgatgagaggttgaagtttggggggccaactgagattctgagtctgaataatttgatggtcagtaaaatctggacgcctgacacctttttcagaaatggtaaaaagtccattgctcacaacatgacaactcctaataaactcttcagaataatgcagaatggaaccattttatacaccatgaggcttaccatcaatgctgactgtcccatgaggctggttaactttcctatggatgggcatgcttgtccactcaagtttgggagctatgcttatcccaaaagtgaaatcatatatacgtggaaaaaaggaccactttactcagtagaagtcccagaagaatcttcaagccttctccagtatgatctgattggacaaacagtatctagtgagacaattaaatctaacacaggtgaatacgttataatgacagtttacttccacttgcaaaggaagatgggctacttcatgatacagatatacactccttgcattatgacagtcattctttcccaggtgtctttctggattaataaggagtccgtcccagcaagaactgtttttgggatcaccactgttttaactatgaccactttgagcatcagtgcccggcactctttgccaaaagtgtcatatgccactgccatggattggttcatagctgtttgctttgcattcgtcttctctgcgcttatcgagttcgcagctgtcaactactttaccaatcttcagacacagaaggccaaaaggaaggcacagtttgcagccccacccacagtgacaatatcaaaagctactgaacctttggaagctgagattgttttgcatcctgactccaaatatcatctgaagaaaaggatcacttctctgtctttgccaatagtttcatcttccgaggccaataaagtgctcacgagagcgcccatcttacaatcaacacctgtcacacccccaccactctcgccagcctttggaggcaccagtaaaatagaccagtattctcgaattctcttcccagttgcatttgcaggattcaaccttgtgtactgggtagtttatctttccaaagatacaatggaagtcagtagcagtgttgaatagcttgcggccaggacaacctgaattctataagttcttgttttctgtttcctatgttttcttaaaaaatagcattgagacttgtgtagatgcttctcagaacatgaaatcaaattggaaatctgtaacgcagcttccgtaagcatgtgtgggcaaaaaagcaataatcctactcctcaaaatagaaagttgaagattgctgaaaaatatgacttttctgtatgttagagaaaaactttatgaggatgaaatgggttcaagatgaatttgtcaacttttgtcttccattgttcagtatttttaattgtcactgtaaataacatttaccacaaggca

SEQ ID NO: 8020 - DNA, 2393 bp, Homo sapiens
  ENST00000523217
acataatctaagaccacaaaccaccttgttccacgtgagaaggaaacaagaaagaagggagccaggggaatcctgcaaatttttaggcaacctctttatctattggattactgacttgaggcaaacaaggaacagagatatgaagggtttgaaagatttctccagttgattggcagagaagagctggctagcagggaggacgaccctaggagggtgaattctgcatttcagtgcactgcaggatggcgtcgtctctgccctggctgtgcattattctgtggctagaaaatgccctagggaaactcgaagttgaaggcaacttctactcagaaaacgtcagtcggatcctggacaacttgcttgaaggctatgacaatcggctgcggccgggatttggaggtgctgtcactgaagtcaaaacagacatttatgtgaccagttttgggcccgtgtcagatgtggagatgacctggactgatgagaggttgaagtttggggggccaactgagattctgagtctgaataatttgatggtcagtaaaatctggacgcctgacacctttttcagaaatggtaaaaagtccattgctcacaacatgacaactcctaataaactcttcagaataatgcagaatggaaccattttatacaccatgaggcttaccatcaatgctgactgtcccatgaggctggttaactttcctatggatgggcatgcttgtccactcaagtttgggagctatgcttatcccaaaagtgaaatcatatatacgtggaaaaaaggaccactttactcagtagaagtcccagaagaatcttcaagccttctccagtatgatctgattggacaaacagtatctagtgagacaattaaatctaacacaggtgaatacgttataatgacagtttacttccacttgcaaaggaagatgggctacttcatgatacagatatacactccttgcattatgacagtcattctttcccaggtgtctttctggattaataaggagtccgtcccagcaagaactgtttttgggatcaccactgttttaactatgaccactttgagcatcagtgcccggcactctttgccaaaagtgtcatatgccactgccatggattggttcatagctgtttgctttgcattcgtcttctctgcgcttatcgagttcgcagctgtcaactactttaccaatcttcagacacagaaggccaaaaggaaggcacagtttgcagccccacccacagtgacaatatcaaaagctactgaacctttggaagctgagattgttttgcatcctgactccaaatatcatctgaagaaaaggatcacttctctgtctttgccaatagtttcatcttccgaggccaataaagtgctcacgagagcgcccatcttacaatcaacacctgtcacacccccaccactctcgccagcctttggaggcaccagtaaaatagaccagtattctcgaattctcttcccagttgcatttgcaggattcaaccttgtgtactgggtagtttatctttccaaagatacaatggaagtcagtagcagtgttgaatagcttgcggccaggacaacctgaattctataagttcttgttttctgtttcctatgttttcttaaaaaatagcattgagacttgtgtagatgcttctcagaacatgaaatcaaattggaaatctgtaacgcagcttccgtaagcatgtgtgggcaaaaaagcaataatcctactcctcaaaatagaaagttgaagattgctgaaaaatatgacttttctgtatgttagagaaaaactttatgaggatgaaatgggttcaagatgaatttgtcaacttttgtcttccattgttcagtatttttaattgtcactgtaaataacatttaccacaaggcagataaaataagaaatgctgacacttccaaaggttgccttaaaatatgtttattttggcttagttcccgagagggcaaaatataaatacagtctaaatatttatcagtaggttaataccagcatgttggaggcctttatgctagtaaaatggctttcagtggcattgtaaagcctacattgagcttagccatttgtttttaacctcgctgtgctcttttacctcaataaaatgtggtgtttgtatacatataaattatacatagctcataaattatgtatgcatatgtacatagctgtagttggactaaaattcagtgtgttttatcctactaaattctccttttaaaataatacacttaccataattctatgaggttgtagaaaaaagtactcattataaggaagccttgtatattatgactatggttatctcttgtgttttccacatttccaattataacactaaataaaacaacaataaacatg

SEQ ID NO: 8021 - DNA, 574 bp, Homo sapiens
  ENST00000524220
atctcagaggaaaggaaaagtatacatccattgggtgactcctatatcaaatcatgaaagaggccagaagtggtgttgcatgtatttgtaacagggtggaatagagtagattagacaaaacctcttctctgagcctgggagtaaggatcattgactgtctacacacaggctagaaaatgccctagggaaactcgaagttgaaggcaacttctactcagaaaacgtcagtcggatcctggacaacttgcttgaaggctatgacaatcggctgcggccgggatttggaggtgctgtcactgaagtcaaaacagacatttatgtgaccagttttgggcccgtgtcagatgtggagatggagtatacgatggatgtttttttccgccagacctggactgatgagaggttgaagtttggggggccaactgagattctgagtctgaataatttgatggtcagtaaaatctggacgcctgacacctttttcagaaatggtaaaaagtccattgctcacaacatgacaactcctaataaactcttcagaataatgcagaatggaaccattttatacaccatg

SEQ ID NO: 8022 - DNA, 591 bp, Homo sapiens
  ENST00000520000
acattgaggatggaccagtaggtgttctggggactctgttccaggagtatacgatggatgtttttttccgccagacctggactgatgagaggttgaagtttggggggccaactgagattctgagtctgaataatttgatggtcagtaaaatctggacgcctgacacctttttcagaaatggtaaaaagtccattgctcacaacatgacaactcctaataaactcttcagaataatgcagaatggaaccattttatacaccatgaggcttaccatcaatgctgactgtcccatgaggctggttaactttcctatggatgggcatgcttgtccactcaagtttgggagctatgcttatcccaaaagtgaaatcatatatacgtggaaaaaaggaccactttactcagtagaagtcccagaagaatcttcaagccttctccagtatgatctgattggacaaacagtatctagtgagacaattaaatctaacacaggtgaatacgttataatgacagtttacttccacttgcaaaggaagatgggctacttcatgatacagatatacactccttgcattatgacagtcattcttt

SEQ ID NO: 8023 - DNA, 555 bp, Homo sapiens
  ENST00000517823
agtaggtgttctggggactctgttccaggtacagatggctgtagcattcataagagggtatttatagagtatacgatggatgtttttttccgccagacctggactgatgagaggttgaagtttggggggccaactgagattctgagtctgaataatttgatggtcagtaaaatctggacgcctgacacctttttcagaaatggtaaaaagtccattgctcacaacatgacaactcctaataaactcttcagaataatgcagaatggaaccattttatacaccatgaggcttaccatcaatgctgactgtcccatgaggctggttaactttcctatggatgggcatgcttgtccactcaagtttgggagctatgcttatcccaaaagtgaaatcatatatacgtggaaaaaaggaccactttactcagtagaagtcccagaagaatcttcaagccttctccagtatgatctgattggacaaacagtatctagtgagacaattaaatctaacacaggtgaatacgttataatgacagtttacttccacttgcaaagg

SEQ ID NO: 8024 - DNA, 573 bp, Homo sapiens
  ENST00000523691
ttgatggtcagtaaaatctggacgcctgacacctttttcagaaatggtaaaaagtccattgctcacaacatgacaactcctaataaactcttcagaataatgcagaatggaaccattttatacaccatgaggcttaccatcaatgctgactgtcccatgaggctggttaactttcctatggatgggcatgcttgtccactcaagtttgggagctacaatgtgcactttgaaggaaaaaaagacaactcgtcaaattcactgctatatttaatttgtttcaaatatttagatgcttatcccaaaagtgaaatcatatatacgtggaaaaaaggaccactttactcagtagaagtcccagaagaatcttcaagccttctccagtatgatctgattggacaaacagtatctagtgagacaattaaatctaacacaggtgaatacgttataatgacagtttacttccacttgcaaaggaagatgggctacttcatgatacagatatacactccttgcattatgacagtcattctttcccaggtgtctttctggattaataaggagtccgtcccagca

SEQ ID NO: 8025 - DNA, 2175 bp, Homo sapiens
  ENST00000521520
ctatgtttgtatttccttttttatagacaatgtgcactttgaaggaaaaaaagacaactcgtcaaattcactgctatatttaatttgtttcaaatatttagatgcttatcccaaaagtgaaatcatatatacgtggaaaaaaggaccactttactcagtagaagtcccagaagaatcttcaagccttctccagtatgatctgattggacaaacagtatctagtgagacaattaaatctaacacaggtaagaatttgaccaaaggatggaaataatccctcaggatgactccagtgcacattttcaaaatatctatttctttttccttcgccttagccattctcagctaagcatgctgttttgcagtgatgagtagctttccttaaaactgattttgcaaccaggtgcatataaagatttgtgtaatcttggaataagtagttttttttatgtatatgatataaagaaccctactgaaaacaataagttgatgtgtctcttcgctctatcatctgctgatcaagtagctttctcatatactgaaatgtacctttgcttgttttcttccagtcaatgttaatttaaaagttgtcaagatttatattcaactgcattctttttgcagactgtcagcagtaataatactgatgtatgtgtcttccaacaggtgaatacgttataatgacagtttacttccacttgcaaaggaagatgggctacttcatgatacagatatacactccttgcattatgacagtcattctttcccaggtgtctttctggattaataaggagtccgtcccagcaagaactgtttttgggatcaccactgttttaactatgaccactttgagcatcagtgcccggcactctttgccaaaagtgtcatatgccactgccatggattggttcatagctgtttgctttgcattcgtcttctctgcgcttatcgagttcgcagctgtcaactactttaccaatcttcagacacagaaggccaaaaggaaggcacagtttgcagccccacccacagtgacaatatcaaaagctactgaacctttggaagctgagattgttttgcatcctgactccaaatatcatctgaagaaaaggatcacttctctgtctttgccaatagtttcatcttccgaggccaataaagtgctcacgagagcgcccatcttacaatcaacacctgtcacacccccaccactctcgccagcctttggaggcaccagtaaaatagaccagtattctcgaattctcttcccagttgcatttgcaggattcaaccttgtgtactgggtagtttatctttccaaagatacaatggaagtcagtagcagtgttgaatagcttgcggccaggacaacctgaattctataagttcttgttttctgtttcctatgttttcttaaaaaatagcattgagacttgtgtagatgcttctcagaacatgaaatcaaattggaaatctgtaacgcagcttccgtaagcatgtgtgggcaaaaaagcaataatcctactcctcaaaatagaaagttgaagattgctgaaaaatatgacttttctgtatgttagagaaaaactttatgaggatgaaatgggttcaagatgaatttgtcaacttttgtcttccattgttcagtatttttaattgtcactgtaaataacatttaccacaaggcagataaaataagaaatgctgacacttccaaaggttgccttaaaatatgtttattttggcttagttcccgagagggcaaaatataaatacagtctaaatatttatcagtaggttaataccagcatgttggaggcctttatgctagtaaaatggctttcagtggcattgtaaagcctacattgagcttagccatttgtttttaacctcgctgtgctcttttacctcaataaaatgtggtgtttgtatacatataaattatacatagctcataaattatgtatgcatatgtacatagctgtagttggactaaaattcagtgtgttttatcctactaaattctccttttaaaataatacacttaccataattctatgaggttgtagaaaaaagtactcattataaggaagccttgtatattatgactatggttatctcttgtgttttccacatttccaattataacactaaataaaacaacaataaacatgg

SEQ ID NO: 8026 - DNA, 576 bp, Homo sapiens
  ENST00000513567
gcgcgcttgcgctgcaagactcggcaagtttgttccgactgtaactccggggatgaggaacggggtctctcgcccctcctccggcttcgcagcccccgaccccaagtgggctccccgcccacagcagtgttcgtcctcctacctcctggccccctcccttccgctgggatttggatctaaccaatgaagctcctctgtcatcagcaccaatgaacccagcaacatgtcatacgtgaaagagacagtggacagattgctcaaaggatatgacattcgcttgcggccggacttcggagggccccccgtcgacgttgggatgcggatcgatgtcgccagcatagacatggtctccgaagtgaatatggattatacactcaccatgtatttccagcagtcttggaaagacaaaaggctttcttattctggaatcccactgaacctcaccctagacaatagggtagctgaccaactctgggtaccagacacctactttctgaatgacaagaaatcatttgtgcatggggtcacagtgaaaaatcgaatgattcgactgcatcctgatggaacagttctcta

SEQ ID NO: 8027 - DNA, 2143 bp, Homo sapiens
  ENST00000295454
aatgcatgaaggaaactccgtttacacatgctcgtaggatcccctgcgtggaaacagcagcttgtctctgactacccggaggacatggagcaccccaaataggaactttagagggattgaaatctgttgcctgttccactaggaatattgtttgcaaggcacaaggtgtcttttggtagtgagcgcgctctgcgcatgcgcaggtccattcgggaattactgcccagcagccgactaagttgcattccttgaatcttcgcagaaaagacaattcttttaatcagagttagtaatgtggacagtacaaaatcgagagagtctggggcttctctctttccctgtgatgattaccatggtctgttgtgcacacagcaccaatgaacccagcaacatgtcatacgtgaaagagacagtggacagattgctcaaaggatatgacattcgcttgcggccggacttcggagggccccccgtcgacgttgggatgcggatcgatgtcgccagcatagacatggtctccgaagtgaatatggattatacactcaccatgtatttccagcagtcttggaaagacaaaaggctttcttattctggaatcccactgaacctcaccctagacaatagggtagctgaccaactctgggtaccagacacctactttctgaatgacaagaaatcatttgtgcatggggtcacagtgaaaaatcgaatgattcgactgcatcctgatggaacagttctctatggactccgaatcacaaccacagctgcatgtatgatggatcttcgaagatatccattggatgagcagaactgcaccctggagatcgaaagttatggctataccactgatgacattgaattttactggaatggaggagaaggggcagtcactggtgttaataaaatcgaacttcctcaattttcaattgttgactacaagatggtgtctaagaaggtggagttcacaacaggagcgtatccacgactgtcactaagttttcgtctaaagagaaacattggttacttcattttgcaaacctacatgccttctacactgattacaattctgtcctgggtgtctttttggatcaactatgatgcatctgcagccagagtcgcactaggaatcacgacagtgcttacaatgacaaccatcagcacccacctcagggagaccctgccaaagatcccttatgtcaaagcgattgatatttatctgatgggttgctttgtgtttgtgttcctggctctgctggagtatgcctttgtaaattacatcttctttgggaaaggccctcagaaaaagggagctagcaaacaagaccagagtgccaatgagaagaataaactggagatgaataaagtccaggtcgacgcccacggtaacattctcctcagcaccctggaaatccggaatgagacgagtggctcggaagtgctcacgagcgtgagcgaccccaaggccaccatgtactcctatgacagcgccagcatccagtaccgcaagcccctgagcagccgcgaggcctacgggcgcgccctggaccggcacggggtacccagcaaggggcgcatccgcaggcgtgcctcccagctcaaagtcaagatccccgacttgactgatgtgaattccatagacaagtggtcccgaatgtttttccccatcaccttttctctttttaatgtcgtctattggctttactatgtacactgaggtctgttctaatggttccatttagactactttcctcttctattgttttttaaccttacaggtccccaacagcgatactgctgtttctcgaggtaagagattcagccatccaattggttttaggtcttgcatatcagttttattactgcaccatgtttacttcaaaaagacaaaacaaaaaaaaaattatttttccagtctaccgtggtccaggttatcagctctttaagagctctattaattgccatgtttacaaacaaacacaaagagagaagttagacaggtagatctttagcagtcttttctagtttccctggatttcactgatttattttttagggaaaatgaaaagaggaccttgctgtccgcctgcactgcttcctggtaaactataacaaacttatgctgccaaaaaaaaaaaaaaaa

SEQ ID NO: 8028 - DNA, 605 bp, Homo sapiens
  ENST00000509366
gcgcatgcgcaggtccattcgggaattactgcccagcagccgactaagttgcattccttgaatcttcgcagaaaagacaattcttttaatcagagttagtaatgtggacagtacaaaatcgagagagtctggggcttctctctttccctgtgatgattaccatggtctgttgtgcacacagcaccaatgaacccagcaacatgtcatacgtgaaagagacagtggacagattgctcaaaggatatgacattcgcttgcggccggacttcggagggccccccgtcgacgttgggatgcggatcgatgtcgccagcatagacatggtctccgaagtgaatatgcatgtcctaaagaaaaaattggggaaataaaaatcccaagccaactattgagaggccaatgagaagagagaaagaagattcacgacagaggttaatattggccaactgaaaacttctgtcttcatgtggggagaactgatctttagaagtgtcgaagttgggaatgagaggaagactggataaaaaatttggagagtaggatatattcacaaaactggaaaaatggattcagtccttggtgggttatttgtgtctgcctcttat

SEQ ID NO: 8029 - DNA, 840 bp, Homo sapiens
  ENST00000381582
gcccagcagccgactaagttgcattccttgaatcttcgcagaaaagacaattcttttaatcagagttagtaatgtggacagtacaaaatcgagagagtctggggcttctctctttccctgtgatgattaccatggtctgttgtgcacacagcaccaatgaacccagcaacatgtcatacgtgaaagagacagtggacagattgctcaaaggatatgacattcgcttgcggccggacttcggagggccccccgtcgacgttgggatgcggatcgatgtcgccagcatagacatggtctccgaagtgaatatggtgagtggcctcccgaggggcccggcggttcggcttacgcagatgggaaatggacaggtccctttgccctctgcgtttcattggcggtcacctcgcccctggcccctgaggtcccactccgcacccgctccccgctccggcacacacacccggtcgcccctggtttgtaatttcgacacacacgggctactgcggtgttccaggggaaacgtgctcggcactattttgggaaggacgagtgactgttgcgccgtggatctgctggggcggagtctgagcgttactttagctgggtttccctgcgtgtttggatgaggagggcaccatctgctggcagccgggcggcctgcactagggtccccggaccggtggtcggcagccatcacctccccaggcgcggtgctggcaatccccatggccctcgcagtccgcgagcccggatgcaccaaggccctgccaccgagagcacagtctgggtttcaaagtgtcctctctctccaggttcaggcacacctggtggcaggagcaa

SEQ ID NO: 8030 - DNA, 563 bp, Homo sapiens
  ENST00000510909
cttttaatcagagttagtaatgtggacagtacaaaatcgagagagtctggggcttctctctttccctgtgatgattaccatggtctgttgtgcacacagcaccaatgaacccagcaacatgtcatacgtgaaagagacagtggacagattgctcaaaggatatgacattcgcttgcggccggacttcggaggattatacactcaccatgtatttccagcagtcttggaaagacaaaaggctttcttattctggaatcccactgaacctcaccctagacaatagggtagctgaccaactctgggtaccagacacctactttctgaatgacaagaaatcatttgtgcatggggtcacagtgaaaaatcgaatgattcgactgcatcctgatggaacagttctctatggactccgaatcacaaccacagctgcatgtatgatggatcttcgaagatatccattggatgagcagaactgcaccctggagatcgaaagttatggctataccactgatgacattgaattttactggaatggaggagaaggggcagtcactggtgttaat

SEQ ID NO: 8031 - DNA, 1961 bp, Homo sapiens
  ENST00000378585
gggctccgcgctccgtccgccccctcgcgcccgcgccgcgctcgctcagctcccgcccgcctgtgccgcctgtgcggccgccgggagccaagtttgcgcggaccccgtcccgagcccgccgcggccatggacgcgcccgcccggctgctggccccgctcctgctcctctgcgcgcagcagctccgcggcaccagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggagtacaccatgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcgcccggcggcagctgcccagaaacttcctgggagaaagagccctcgggctgccttcccctctgcgtgtttcgaagtgggatgacagtcggccacggaaaacaagaggaagcctcggcctccctgagctctgaccccagcctcacccgaaaggccagcctggggctctccggcaggcagcccgagacctgcacagatgaaggagcagaggttctgaccgagaggctgagccaggccggggtctgggcccttcagggagccgcggatttttatgttcagaaagtgatcctggtttctaggtctttgctctgcaggatcgggatcagagcgtgggaggaggtgggggtggacgtccatccggtgaacagtgaaggcgtttgtgaggtctttctggtcccagcatgaaataaagccttggcctgggggccgcttcattctccctca

SEQ ID NO: 8032 - DNA, 1282 bp, Homo sapiens
  ENST00000638411
cgcgccgcgctcgctcagctcccgcccgcctgtgccgcctgtgcggccgccgggagccaagtttgcgcggaccccgtcccgagcccgccgcggccatggacgcgcccgcccggctgctggccccgctcctgctcctctgcgcgcagcagctccgcggcaccagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggtaggtgccaccagcctctgcctcaggcacggagtacaccatgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccgggga

SEQ ID NO: 8033 - DNA, 1247 bp, Homo sapiens
  ENST00000639045
gtgccgcctgtgcggccgccgggagccaagtttgcgcggaccccgtcccgagcccgccgcggccatggacgcgcccgcccggctgctggccccgctcctgctcctctgcgcgcagcagctccgcggcaccaggaggacaggtatgacaatcaccacaaactggacggcttgaaacaacagacgcctattctctcgcagctcgggaggccaggagcctgaaatcaagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggagtacaccatgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttc

SEQ ID NO: 8034 - DNA, 1632 bp, Homo sapiens
  ENST00000640067
gtgccgcctgtgcggccgccgggagccaagtttgcgcggaccccgtcccgagcccgccgcggccatggacgcgcccgcccggctgctggccccgctcctgctcctctgcgcgcagcagctccgcggcaccagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggagtacaccatgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctgcttcctgtgtggacggagcgctcctgccagggctcccggggcagggccgggctctgccgcccacctgtgtgcttttcctccagacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcgcccggcggcagctgcccagaaacttcctgggagaaagagccctcgggctgccttcccctctgcgtgtttcgaagtgggatgacagtcggc

SEQ ID NO: 8035 - DNA, 2377 bp, Homo sapiens
  ENST00000638604
gtgccgcctgtgcggccgccgggagccaagtttgcgcggaccccgtcccgagcccgccgcggccatggacgcgcccgcccggctgctggccccgctcctgctcctctgcgcgcagcagctccgcggcaccagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggagtacaccatgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctgtgagtgggtgtgcaaggcgggtaggggcttctccagcagtggatgggggctcagactgtcagcccggggcctggacaaggctggcccggctcaggatgcaggaaagcaccaaaccagcttctgcatgcaagaagcctgggcaggaggagaaggggccagaaagcctggagcagtctggcttgtgggtctgtgccctgcctggggagccgggccatggagcccagacatggcacggattgatattgttgagccagtgcagcagcccctgtgtgtcacctgacaacggtgaccccatctgtgtcccatccacctgcccggaggagcccgacgtggtcccagagccgaaggtctcctcgctcctggctggggtcctgctcggtccccatcacgatggcgtcggccccctgcaggcttcctgtgtggacggagcgctcctgccagggctcccggggcagggccgggctctgccgcccacctgtgtgcttttcctccagacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcgcccggcggcagctgcccagaaacttcctgggagaaagagccctcgggctgccttcccctctgcgtgtttcgaagtgggatgacagtcggccacggaaaacaagaggaagcctcggcctccctgagctctgaccccagcctcacccgaaaggccagcctggggctctccggcaggcagcccgagacctgcacagatgaaggagcagaggttctgaccgagaggctgagccaggccggggtctgggcccttcagggagccgcggatttttatgttcagaaagtgatcctggtttctaggtctttgctctgcaggatcgggatcagagcgtgggaggaggtgggggtggacgtccatccggtgaacagtgaaggcgtttgtgaggtctttctggtcccagcatgaaataaagccttggcctgggggc

SEQ ID NO: 8036 - DNA, 1707 bp, Homo sapiens
  ENST00000638771
cgggagccaagtttgcgcggaccccgtcccgagcccgccgcggccatggacgcgcccgcccggctgctggccccgctcctgctcctctgcgcgcagcagctccgcggcaccagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggagtacaccatgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagaggtgagggcctggggccgagccagggacagcactgctgggggccccaaccaggacccttcagctgccccagcccactgtgggtcccagctgtgctccctgagcgtggggggctggagctgctggtccaggcggggcccccgcatgggaacacctgtggtccagggccctgggagctgcaccccagtgctcagccctgtctcccccaccggccttcgtgcagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcgcccggcggcagctgcccagaaacttcctgggagaaagagccctcgggc

SEQ ID NO: 8037 - DNA, 561 bp, Homo sapiens
  ENST00000639935
aagtttgcgcggaccccgtcccgagcccgccgcggccatggacgcgcccgcccggctgctggccccgctcctgctcctctgcgcgcagcagctccgcggcaccagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggagtacaccatgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccggtgagcgggctgcccacccggactccgggggagagcctgcccgggccaagcgtc

SEQ ID NO: 8038 - DNA, 1684 bp, Homo sapiens
  ENST00000640949
gtcccgagcccgccgcggccatggacgcgcccgcccggctgctggccccgctcctgctcctctgcgcgcagcagctccgcggcaccagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggagtacaccatgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcgcccggcggcagctgcccagaaacttcctgggagaaagagccctcgggctgccttcccctctgcgtgtttcgaagtgggatgacagtcggccacggaaaacaagaggaagcctcggcctccctgagctctgaccccagcctcacccgaaaggccagcctggggctctccggcaggcagcccgagacctgcacagatgaaggagcagaggttctgaccgagaggctgagccaggccggggtctgggcccttcagggagccgcggatttttatgttcagaaagtgatcctggtttctaggtctttgctctgcaggatcgggatcagagcgtgggaggaggtg

SEQ ID NO: 8039 - DNA, 1578 bp, Homo sapiens
  ENST00000640030
ggcaccagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggagtacaccatgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcgcccggcggcagctgcccagaaacttcctgggagaaagagccctcgggctgccttcccctctgcgtgtttcgaagtgggatgacagtcggccacggaaaacaagaggaagcctcggcctccctgagctctgaccccagcctcacccgaaaggccagcctggggctctccggcaggcagcccgagacctgcacagatgaaggagcagaggttctgaccgagaggctgagccaggccggggtctgggcccttcagggagccgcggatttttatgttcagaaagtgatcctggtttctaggtctttgctctgcaggatcgggatcagagcgtgggaggaggtgggggtggacgtccatccggtgaacagtgaaggcgtttgtgaggtctttctggtcccagcat

SEQ ID NO: 8040 - DNA, 1172 bp, Homo sapiens
  ENST00000640423
tggcatgaagcgcacgcccccgcactctggcccttcccatctgttcacggtgggaaaacgaccgggggctctcctagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggagtacaccatgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgat

SEQ ID NO: 8041 - DNA, 663 bp, Homo sapiens
  ENST00000639625
acccgcttgaggctgtatctgaactggggtcaaatctgtctctaggcttgctgtgggggaggccactgactcaggtcccggcccctcaactctcctggagggctcgggccaggctcgggcctggcgacctggaggacatgtctgaagccacccccttggatagaaatgattctgagaatacaggggggttaatctcaaggccccacccctgggaccaatccccatcctgtgtgcaggaggacaggtatgacaatcaccacaaactggacggcttgaaacaacagacgcctattctctcgcagctcgggaggccaggagcctgaaatcaaggtgtgggtggggctcgttcccctggaggctctgagggaacctccgtccctggcctgtctccagctccggcggtggctggaaaccctggcctcccctggcctgtggacgcctcaccccaatctctgcctcctctgtccccaggcttcttccctcttctcttctaaggacaccagtccttgggtttagggcccacccaatccagtatggcctcatcttaactaattacctctgcaaagaccttattcccaaataagctcacattctgaggctctgggtggatgtgcattttgggggacgctgttcaacccagtgcaggtgagcagatgggggccg

SEQ ID NO: 8042 - DNA, 2393 bp, Homo sapiens
  ENST00000639777
ggaggagatgcctccctcaagcctgggcgtccccatggccctgctgtctaccccgagctgctccgaggttgagctaaaccacagaagcacatggccatttggggatctggagcccaccctgggccttcctgggaggagacagagagtaggaggctgtgggcccgggttttggggccctgtcctcttcctgtccctgccccttgcctcctcctcacattcctcttctccaaaccgtctaatgggggaagcttcgccctcagaagccgacagggagacctctttggtgagggaccccaggggtggagacccgaggccggcctccgcgggctggttgaggagggaggctgttagcctgggagcttggcccacgctggggggctctgtccaacccagggccacctccctcaaagccaggagggctaagtgggcactgaggccggaggaggaagccaggtcagggccagtggaagaggctgaggacctcccggggttccctgtgtccagccagaggcttggggactggccaggcccccacctgcaagggctcccacagtggccccccatgccctggcccaggtgcccagaacagtgctgcatccccaggaagggacccaggctcagtggaattaaattaagtcctggcctgtctgaccggtggctttgcatccccagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggagtacaccatgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcgcccggcggcagctgcccagaaacttcctgggagaaagagccctcgggctgccttcccctctgcgtgtttcgaagtgggatgacagtcggccacggaaaacaagaggaagcctcggcctccctgagctctgaccccagcctcacccgaaaggccagcctggggctctccggcaggcagcccgagacctgcacagatgaaggagcagaggttctgaccgagaggctgagccaggccggggtctgggcccttcagggagccgcggatttttatgttcagaaagtgatcctggtttctaggtctttgctctgcaggatcgggatcagagcgtgggaggaggtgggggtggacgtccatccggtgaacagtgaaggcgtttgtgaggtctttctggtccc

SEQ ID NO: 8043 - DNA, 960 bp, Homo sapiens
  ENST00000640981
atgtggcccttgccctggaggtggccagcatcgaccacatctcagaggccaacatggagtacaccatgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggtacggggcctcgccgctgctccgagggagctggaagggcggccctggggaacaggactccccatccctcggctgggggctcagcactggcctctggaccatgccagctgtcctggggcagtggccagccgggccaggccaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactac

SEQ ID NO: 8044 - DNA, 504 bp, Homo sapiens
  ENST00000638763
catgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaactggccagttcccacggctcagcctgcacttccacctgcggaggaaccgcggcgtgtacatcatccaatcctaca

SEQ ID NO: 8045 - DNA, 2171 bp, Homo sapiens
  ENST00000639070
gacacttaaaaaatcaggaggcatgtggccggatgcggtggctcacgcctgtaatcccagcactttgggaggccgaggtgggtggatcacgaggtcaagagatcgagaccatcctggccaacatggtgaaaccccgtctctactaaaaatacaaaagattcgctgggcgtggtggtgggggcctgtagtcccagctactcaagaggctgaggcaggagaatggtgtgaacccgggaggcagagcttgcagtgagccgagattgcgccactgcactccagcctggggactgagcgagactccatctcaaaaaaaaaaaacaaacaaaaaaaagaaatcaggaggcagccgggtgcagtggctcacgcttgtaaccccaacactttttggaggctgaggtgagagtatacttgagcctgggagtttgagaccagcctgggcaacatagggagatcctgcctctacaaaaataataaaaaacattagctgggcttggtggtgtgcacctgtggtctcagctactcgggaggctgaggtgggaggattacccacctcaagccccggggggttgaggctgtagtgagtcaagattgcaccactgcactccagcttgggtgacagagtgagaccctgtctcataaacaaacaaaaacatcgggatattttacataggaatttaaatatttgacctctcctagaaaatcaagtgcgtggcaactctgggcctattcccgtgtgttcctcagccatcgctcgggccagggcctgggtgtgaaggctgtcccctgccccgtaggcccccagcctagttcaatagtcaagcgttttgaagagaatgaatgaaatccagttcttgacggtcctaaaggaatacttgacgtctatgaagttgagcagtttccaggtttacctggattctgggcaaacacagtctgagaagtagctggggctccaggcaggtgctcagggggcatctctgcaggggaactgccaggctttcgggagggctggcctcacccccaaggcctcactgccatgcttgtcttggcagaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcgcccggcggcagctgcccagaaacttcctgggagaaagagccctcgggctgccttcccctctgcgtgtttcgaagtgggatgacagtcggccacggaaaacaagaggaagcctcggcctccctgagctctgaccccagcctcacccgaaaggccagcctggggctctccggcaggcagcccgagacctgcacagatgaa

SEQ ID NO: 8046 - DNA, 2036 bp, Homo sapiens
  ENST00000640892
tgtaaccccaacactttttggaggctgaggtgagagtatacttgagcctgggagtttgagaccagcctgggcaacatagggagatcctgcctctacaaaaataataaaaaacattagctgggcttggtggtgtgcacctgtggtctcagctactcgggaggctgaggtgggaggattacccacctcaagccccggggggttgaggctgtagtgagtcaagattgcaccactgcactccagcttgggtgacagagtgagaccctgtctcataaacaaacaaaaacatcgggatattttacataggaatttaaatatttgacctctcctagaaaatcaagtgcgtggcaactctgggcctattcccgtgtgttcctcagccatcgctcgggccagggcctgggtgtgaaggctgtcccctgccccgtaggcccccagcctagttcaatagtcaagcgttttgaagagaatgaatgaaatccagttcttgacggtcctaaaggaatacttgacgtctatgaagttgagcagtttccaggtttacctggattctgggcaaacacagtctgagaagtagctggggctccaggcaggtgctcagggggcatctctgcaggggaactgccaggctttcgggagggctggcctcacccccaaggcctcactgccatgcttgtcttggcagaatcacctccactgtggcctgcgacatggacctggccaaataccccatggacgagcaggagtgcatgctggacctggagagctgtgagtgggtgtgcaaggcgggtaggggcttctccagcagtggatgggggctcagactgtcagcccggggcctggacaaggctggcccggctcaggatgcaggaaagcaccaaaccagcttctgcatgcaagaagcctgggcaggaggagaaggggccagaaagcctggagcagtctggcttgtgggtctgtgccctgcctggggagccgggccatggagcccagacatggcacggattgatattgttgagccagtgcagcagcccctgtgtgtcacctgacaacggtgaccccatctgtgtcccatccacctgcccggaggagcccgacgtggtcccagagccgaaggtctcctcgctcctggctggggtcctgctcggtccccatcacgatggcgtcggccccctgcaggcttcctgtgtggacggagcgctcctgccagggctcccggggcagggccgggctctgccgcccacctgtgtgcttttcctccagacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggact

SEQ ID NO: 8047 - DNA, 1578 bp, Homo sapiens
  ENST00000640317
attcccgtgtgttcctcagccatcgctcgggccagggcctgggtgtgaaggctgtcccctgccccgtaggcccccagcctagttcaatagtcaagcgttttgaagagaatgaatgaaatccagttcttgacggtcctaaaggaatacttgacgtctatgaagttgagcagtttccaggtttacctggattctgggcaaacacagtctgagaagtagctggggctccaggcaggtgctcagggggcatctctgcaggggaactgccaggctttcgggagggctggcctcacccccaaggcctcactgccatgcttgtcttggcagaatcacctccactgtggcctgcgacatggacctggccaaataccccatggacgagcaggagtgcatgctggacctggagagctgtgagtgggtgtgcaaggcgggtaggggcttctccagcagtggatgggggctcagactgtcagcccggggcctggacaaggctggcccggctcaggatgcaggaaagcaccaaaccagcttctgcatgcaagaagcctgggcaggaggagaaggggccagaaagcctggagcagtctggcttgtgggtctgtgccctgcctggggagccgggccatggagcccagacatggcacggattgatattgttgagccagtgcagcagcccctgtgtgtcacctgacaacggtgaccccatctgtgtcccatccacctgcccggaggagcccgacgtggtcccagagccgaaggtctcctcgctcctggctggggtcctgctcggtccccatcacgatggcgtcggccccctgcaggcttcctgtgtggacggagcgctcctgccagggctcccggggcagggccgggctctgccgcccacctgtgtgcttttcctccagacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcagg

SEQ ID NO: 8048 - DNA, 523 bp, Homo sapiens
  ENST00000638804
gagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcct

SEQ ID NO: 8049 - DNA, 1295 bp, Homo sapiens
  ENST00000640688
gtcctgtggccagacctagggccggaggccccctgacatttcaggccatgtggttggtggggagggcaggggtctaagtctctcttctgagccctggtgggccccgtagctgccaagccctgcagcccctgagtcccatggttgggctgggctgggcagggatgggggcactgacggtggctgtcctggcagctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcgcccggcggcagctgcccagaaacttcctgggagaaagagccctcgggctgccttcccctctgcgtgtttcgaagtgggatgacagtcggccacggaaaacaagaggaagcctcggcctccctgagctctgaccccagcctcacccgaaaggccagcctggggctctccggcaggcagcccgagacctgcacagatgaaggagcagaggttctgaccgagaggctgagccaggccggggtctgggcccttcagggagccgcggatttttatgttcagaaagtgatcctggtttctaggtctttgctctgcaggatcgggatcagagcgtgggaggaggtgggggtggacgtccatccggtgaacagtgaaggcgtttgtgaggtctttctggtcccagcat

SEQ ID NO: 8050 - DNA, 872 bp, Homo sapiens
  ENST00000522053
aacagccagagagtaagtagaagctcatgaggctgaatgcttaggcctagcactggcacactcgcttttgtatatatattattagccgaagccaatcagatgatccagcccaaagtcgagaggcagaggaatagccttatccaggagaagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctcccc

SEQ ID NO: 8051 - DNA, 2849 bp, Homo sapiens
  ENST00000640500
attctttcactgctggaggcagagagacactgtcagtctctccctggaggacagttgactaagtgtggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgc

SEQ ID NO: 8052 - DNA, 1101 bp, Homo sapiens
  ENST00000638253
tggaggacagttgactaagtgtggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaat

SEQ ID NO: 8053 - DNA, 3899 bp, Homo sapiens
  ENST00000639278
gtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctaaggtggttctattgagagttggcatattacctgccagctataacaaggacatgaggactggctttcaaacaagttctgatgagtcctttggaaaaagccccttggccctctctgtcagctacgccattgcagagtagattttgttgcaaagatagaggcagattcccttattcagggtcatggaaatggcagaagaagaaaaggcagaggagaacaggataaaaatttgagaaaatgaaattacctgagaatttcatgcacttctttttaggcaattagatgattcatcagaactagcaagaaaataaactaggaatgagaagctgaaagtttattttcctgtttaatatgccttttggataattgtgtcaagactcacctattaagttatccgtgatgataattagaaaatagaatcatagtatttttaaacaggggaaccaggcaatagaaaacttccttgcaattgaacaactctggcttcttcagtcaagtaattgtagattaatttattaaaaatttcactagtaattacaaaattacacttaactttaagcaaatactttatcccaagctcagaactctccttctgtgtttataatttcagttcatttcacttactgtgttttcaaaatgtatttttaatttatcttgtctctctctttttttttcattttttttctcctttttattaaaaacaaatgcaattctcttttctgtctacaaacccaaagcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttaca

SEQ ID NO: 8054 - DNA, 3799 bp, Homo sapiens
  ENST00000638660
actactactcgggaaactgaggcacaatcgcttgagccctggagttccaagccgtagtgggcaatgattgtgcctaagaatagccactgtgctccagcctggaaaacatagcaagacaaaaaaagaaagagaaagaaagaaaaaaaagaaagaaagaaagaaagaagaaagaaagaaagaaagaaagaaagagagagagagagagagaaagaaagaaggaaagaaagaaagagaagagaagagaaaaggaaagaaaagaaagaaaagaaaagaaaagaaaaaaaagaaaaaagaagttgtcattcactatttccagggctcacttgttttgcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgc

SEQ ID NO: 8055 - DNA, 3710 bp, Homo sapiens
  ENST00000638552
ggcaatgattgtgcctaagaatagccactgtgctccagcctggaaaacatagcaagacaaaaaaagaaagagaaagaaagaaaaaaaagaaagaaagaaagaaagaagaaagaaagaaagaaagaaagaaagagagagagagagagagaaagaaagaaggaaagaaagaaagagaagagaagagaaaaggaaagaaaagaaagaaaagaaaagaaaagaaaaaaaagaaaaaagaagttgtcattcactatttccagggctcacttgttttgcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaa

SEQ ID NO: 8056 - DNA, 3150 bp, Homo sapiens
  ENST00000640574
tagccactgtgctccagcctggaaaacatagcaagacaaaaaaagaaagagaaagaaagaaaaaaaagaaagaaagaaagaaagaagaaagaaagaaagaaagaaagaaagagagagagagagagagaaagaaagaaggaaagaaagaaagagaagagaagagaaaaggaaagaaaagaaagaaaagaaaagaaaagaaaaaaaagaaaaaagaagttgtcattcactatttccagggctcacttgttttgcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgtatgtatcattttccattggcaccattgaaatttttatgatttcggtttagtttgttttcattagcctatctgcaggctaaggctcagcagtttgggctccaagatgaaaacagcatgtatgagtttagccaggccataacgattcatttacagtcattagttacttgagagagactcaagtctgtttctattttctgtgtcagagttcttatgcaaatataattacctgctctctttattttgtggagactaaagccatttttgagaaatgtgaccttcttcttgttgctattattccaggtttcactgattttttgagatggagtgtcactctgttgctcaggctggagtgcagtggcgggatctcggcttactgcaacctctgcctcctaggttcaagcaattctcctgcctcagccccctgagtagctgggactataggcacacgccaccatgcctggttaatttttgtatttttagtacagacggggtttcaccatattggtcaggctggtctcgaactcctgacctcaggtgatccacctgtctcggcctcccaaagtgctgggattagatgcgtgagccactgcgcctggccatgataatattattaaatcactgatattttaaattaaaacttccatctcaggcattccactaggaagctataaggtccttgaagtttcaaggctgactacatttttgcaaatgatttagtgtgtgtatggaggtggaatgtgggtattgtcaccagataatttctattgatttcattctcgaaatgtatctttttgtttttaaaacaaatgatttactattatatgggcaagttagttagcctccttgtgtgttttatatatatatatgtagtgtattatttaaaaacacttgtcttatggggctcctatgagaaataaatgtggcaatgaagggcaaaacaaaaaatcccaaaatattacatagtactctacacatgaatgtacttaacattagtagttggtgatgatagttgattttgatgatttatacagtttccagcctggattgacttcagtgccacaatttgaaaacagggaggatgacttctacttgcaaccaaactttaaatagtgaggatgaagcataaacacaaatgcctaaagcaactgttttttattgtgagtgttgaggagagcacatagttacccatttacacacctgaacaaagtggctggctcatagaaatccccatgaaagttaaggtccattcccttccaagatatgggcaaagagaatcacctgacaatcctggatcatggccttctgctttgagagccgtaataacgctctacctatccaacccagagactttggaggttgaattgtaaggaaggaatttagctgattctaggttgtattctgatgcagctgcagaaacccaagtgaaatactacaagagtaatgtgtttatttgaatgtaagactttggaacatggaaagaaagaaacatcattattcttgatttaaaaaatgctttctttaattgctcaaatatttacaatgctttatgcagtccttcccttccctgtctgttttgcctctctctgactttccattttctctatccttgttttattttccttgttgtgttgtttttgtttgctccctcttgttcactttccatttcactctccctcaagaaggtggttctattgagagttggcatattacctgccagctataacaaggacatgaggactggctttcaaacaagttctgatgagtcctttggaaaaagccccttggccctctctgtcagctacgccattgcagagtagattttgttgcaaagatagaggcagattcccttattcagggtcatggaaatggcagaaga

SEQ ID NO: 8057 - DNA, 11735 bp, Homo sapiens
  ENST00000639111
gaccacaaaccttctgtcattgatgatgtagcttctgggcttgctaaagcatctcttgtccccatgaatgccagtccttgcatgctggtgtgtgcagtaaagggttaaaaagctttggaaagacaccacgcatgtgttaattcgtgctgcagcagcgtgcatcacttccactttgacctcatagttaatctgcgtgatagttaatcacgcagagtctctagtgatttttttcctatttattttaaatacacacacccacagggctctgccccctgtaaaagaaaaaaaatcaaaacaaacaaataaataaccccaaagagatggacccaggggagaacgcgtaagtgtgaggggcatgagtatacacgagtgtgcgtgtctttccctctcccttatttgtctccgtatgagtctctccttgtaccctccccctgcctcgatgatattactcccccagacttggaagccgctgccagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgcattctaatccatggtggcatctcagtagtctggtgggactgtttgtcttagagattgtgacctctctttcctgcctcatttccccaaatcccctctcagtgagctttatctgtgagctgtgtgactgtgttttgcatggcggtactcttcacctcaaaaaaattaagagaggcatgtgggttgtagagtgaagaagaaaggcagacatgtaataaagtaagtaaaaattcaagtcttctctacctcaagaatttcggtgtggttaacattaattccagtgccagacaaagttgggatcccagctttactatttaccagttgttagacaattgtcaattcagactttagaatcctccattaaaaataatttatgtatttgtttatttgtttagagatggggtgtccctctgtcactcagtctgaagtatagtggcacagtcatagctcactgaagcctcaaacttctgagctaaagcattcctcctgcctcagcctcctgaatagctggaactacagatgcatgccaccatgcccagctagaagtctccattttagcagctataaattagatataccaatgctaacctatgtagtgacactcaacaaatggtcaaaagctctctccctcacttccgatgccttccatgcactgctgtcatgctcccttcatcctatcaaactagcttccctaatagaatccagcattaggcatataagcctttaagtgactctacatcactctatttttatttttaggaaatatttgcattgcaagtcttttaaactatatgtgggaaatttctgtctcattggaaaaaaacttacacattacattagttatttttaaggccaaagaactgttatttgtaccctcaaaatttacaaacatacaaagttgattagccctactccagagacaatgtcatgttttcttgaactcttttgaaattctcccaggaatataatattatcttcacaacacagctgccctaaccatccttggccccattctcttggcccctcatatcttcctgcatctaatttaatcatctatttctcaccttccaaacctataaaaatatagttttcacttagatgttgtctgctgtctaactcaatgccctgaactttagctgaattcatatctttatatggccttcattccttgcattaagtctcaatattattctgactagtagcaaaaatttttgtctgcaatgaaggtcaaattaagttaacaaaatgatgtggtcttcagggattatgtcaaaaattgctatctctatgctttgtcactatgaatctttgtcaaaggtgtagaatatgggggaatgacgtagaccaagagctcggctatgttttctagtgctcagtgaactgccaaaggtcacacagctagttaatgacagatcagggggtcatctaagcattgctctttccactgtgtctcacagtatttcagaatttagaagtaaaattctggaatactttatctttctgttaatattttaggatctgccaaactgcaggatgctttccttctttgatctaagcctcactttgactcattttattgcaatgagacaggaatttgagaatacctagtaacagagggaagtcaatgggttttgtatttattttattccttctcatgtgaaatgaccaattgatatttaatattacccatactgctttcagaatgctgtttcaaagaaacatctaaacaactccagacctagagttagcctttgtcctttgggatatgtggcagtagacaaccaaaaagtttccatggctaggatctgcaggctcattctttctactatttaagcaaagtggtggggaatgacctaactattatgattctttctaaggttacagattataagccaattgcaaaatccagttgtaactttcttttgccacattttggataataaagaaatagtttcctctaattatggtttgtgtaactaattggaaaagcagaggctcttgctccagattaactaggttcaaatatcagccctgtcaacttttgtctgccttagttttctcacctgaaaaatggagataatattggtgtgtatctcagactttattataaggagaaacttagttaataccaaagaattactggatgctagtaattttcctcagtaaggatataaagtttcagaaaatacagggtacaagaaccatatctactttgcttaaaaatattgatcatcatttgtgaggactctcttttctcataaaaaaaaaagtcactggaccggggatagaaatttcatttaacatctggggatttccaaatattcctatcttgatgatattcagtttcttacgtaaacaagggaatttggcccctttttctccagcagatttttattcgatcacttctctgctatttgctatggcctgatgtgattgattaccatctaacattctgactctattaaactctgtcttatctccatacaggtatcttggctcatttatcttatttccaccctgagacttctctaaaaaagcacaattttcctagaatgtcgtcctctgctcaacagattcaacagtctctaattaaagactctacctggtctgtaaggtcttcccagtttcactaaagttcaatatgctattttcttttatctcttccagttcttgatgtgacttttgaatggcctaatcctaatgtttatcttagctaaatacttacattcatccaatcctctttgtaaacaaacattaaatgtacaatgctgtgacaagaatatattataaataattcactatcaattggcatcttaaatcaggttgtttatcttctatctccatgctctataaatttgcctcgcagtttttttttttctgagacttgtgtgttttatgggtgtggaattaagttcctcatcaaataggttttaattaagcatctatacattcagcttaatataaagttttcagtaaattcatgccatgggcctaatatagggccctgtgagtgcaggaagaggtaaatttcaggtatgctttgccctgaaatgcccataatatgatagaggagtcagaaaagaatacaaataactctaatggagctgcacacaagtagttgtagatagaataagtcatattctaactgtgagtgaagtcagaaaagggtttctctgtataaaaagcattcctctacatgtaaggaggtcccatcactgctcaaaatccccctttctgtaattactaataaaaatcctatagactatttgaaaactatgtacatgtacataacaatattgttcttaatccattagcaagagttagtcactaaaatagtatttatctttctatttttgttttcctccatatgtatttacagctgagggttttttccccacatatatttaaacacacggattagacaggtgaatagaagtatagatatggacatacatctgctttgaagtctcatttttccacactattatatatgtgtgtgtgagtatatttaacataacattttctggctttccattattatatcacaggactgtgtcataatttatttagtcaatcctttatttctgaaaatttgcattatttcttatttttgttgctgtaagtaatattacaaaactgtttttgttgctataagtaatattacaaaaatatttttgtcacaggcatatatatatattcctctattttcatagaatatatccctaaaacatgagctttgctgaattaaaatgtataagcatttaacaattagagtcctgacagaaaacaaatggtatactccaaggagtaattgaagaaaaattaatgaagggttacttacaaagattaggcaaggttaaagtctaccaattataggatggtttagtacaacaggtctagcagttgtcaactgaactagttacctatatccgttgtacaaatttcaatgaactcagtgacttagaacaacaaaaattcattatcataattaatttcagaaggtcagaaatttcagtggctgaagtcaagatgtgagcaaggctgcattccttctgaaggatctaggggagaattaatttcttgacttttccatgttctagagtcctcttgaattccttggcttgtggctcatgttcacctttaaagcaagcaactgcatcactcagtccctttccttcatctttcctctggctctgacctcaagcctcctacttacaaagacccttgagattacattggacccacccaaataatccaagatgatcttgtcttcagatccttaaccatgcctgcaaactcccttttaccacgtaagatatatgtacagtttgcagggattcgaacaaggacatttttggggacctattattttgcctaccacactaccttagtcattaaagtacaaaaggaagggacagttacaggacctagaaagagctgtagaacaggagccgtgactttaaactaatacaaccactgcccaacagcggccagtcaaggagggagagtaggaataagtaatcagaattctctcttctcctacctaaagtatatctaattggtcaaagcaaatggaaactagtggacagggaaatgcagatagggtgggccagaggtcagccttatggggcacaccatgtggtgaagaactctgaagaatggatccagagaaatgactggaaattatccagaaaacctctccaaaaatcagcataagtggtacaaaagaaagcttctttacttgtaccctacttaacataaatttctgaaataaagaagaaatttagggttttcaaatagatttctatgccatggaaaaagtagtctttaaaagttattacactggaatattacagatccatatattttatattgggtaatctgttcaacctgaagaacttttcaataggctttaaagctataaagcaaatgcctttatacaacactttctgggagttaatgtgggttaatagacatgcccttctggtgagtcctgtggcaagggtgccaattcagtcagtgatttgcaggccacagcaccctcgagctattttcacgaagggtggaccttctgagccaatatttctcatctgttattgcagaacttaaaaagggacagggcttctgagtcactgagagcccaagggtacaattctatactgggttcaaggctgaaaatagcaaaaccacagatctatttctgtaaacacaatgactgtaaggacaactacaacttaatttggacaacttaaactaaagtgactaaagcaaaccatttggaaaacagactagcttagtactgacactctgaacacagcctcttatagtgtacaagactatgactttctcattgacagccttcccatcctcttaaagtcatgggggaaactgagtccttattagggctagattgtgaaccctgttgaacaaaaaagaaggacaattttacacggcacttaaatttagctattctcttctaaacctccattgattctgcatctcccctttcattctttcaatctcttttttttcttcaaaaagacttgatgtcactgtgaagcaatgaagatgtgattcaattcaataagtatgttgagtgcctaccatatgccaagaactgccctatgcattggagatatcttggtaaaaattaatggctcaggccctatccttacagaatttacaatataatgcaaaaagaggtgagaaatgtgaaattcagtgggtggttagtattattaatgcagaggtaaacatctgatcacaaaagcctcacccttccccaaattctgtatatataaatgtatggggtaggcttaagctgatattcttcaattaacattaatagatttatttcttagatatagaaaataaacctataaagtagtggatcgtggggtttctttaggataatacttttttcatttttaaaaattgctagtatctgctagaggattgaatcaggttttttttcattataaatgtcttttcaggtatgtatatgaaattacacaggcaacatgtatttcttttgaaaacacattggttttcaggcatagtgatcttttaccaagggactaaacgatagagaatcttaaagtgctctcagtggtgttttatattaaatagttgacttccctagtttggcattgtggaattagtaccaattattaaagtaataaattcttgctgctaccatgaaagttggggctttcaaacttgtattgatctatgataagcaataattgtacattttaagctaatatacatgcaccatgcatatccatgcatttgcaatatacatacttgatgcaacatttcttgtaaagctatagcttctcaaagtgagggccaaagtttacacttctaaatctttattgcctaacacagtgcctgacccataatagccacttgagagatgaagtttttaaaatacagtttgtcaaatggatgctgctggactattatttgtaaagtttttatttaaaatacccattctatttttttatttttaaggaggaatatatatatataaatatatatacatatatgtgtgtgtatatatatatgtgtgtgtgtgtgtgtgtgtgtgtaatcacaacattctaaagcatcctttcacaaatcttcccccagaagagtaccattaacttgatgaacataatcaaaagtaatcctcagatgttaatgtgagagtatcatcaaaggcagtatctactgaaaatccccatgaaatttaagacaacttactgagatttgttatttagcaattaactatcaatggtaaccaatcaactcaattagttgtggggacaaacaagaaacatatttccttaaatgagattttgccaggtaaaattctaacaagggtcaagactaaaattactttctttcttgataaaaatatggtttggatgtttgttctctacaaatctcatgtggaaatgtgaaccccagtgttggatatggggcctggtaggagactattggatcataaggcaaatgtctcatgaatgctttagcaccatcctcctaatggtaagtgagttctcgctcagctacttcacaaaatatctggttgttgtaaagattctgggacttcctccttctgtatcttgctccatttctcatcatgtggcgtgctgctcctgcttcaccttcttctatgagtgaaagctccctgaggcctcaccagaagccaagcagatatcagcaccatgcttcctgtatagcctgcagaaccatgagccaattaaactcttttccttcatatattacccagcctcaggtattcctttatagcaacacaaaatggactaatacaacaagttagcaattattcgtaattgtcttaacatctttaagccctcactgaacccaatttggaaagtttattgtaattttttgcataatgtcttaatacttaatccaaggtagaaaaataaaaggatgataattttctggt

SEQ ID NO: 8058 - DNA, 3662 bp, Homo sapiens
  ENST00000639975
acttccactttgacctcatagttaatctgcgtgatagttaatcacgcagagtctctagtgatttttttcctatttattttaaatacacacacccacagggctctgccccctgtaaaagaaaaaaaatcaaaacaaacaaataaataaccccaaagagatggacccaggggagaacgcaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgc

SEQ ID NO: 8059 - DNA, 9960 bp, Homo sapiens
  ENST00000639213
acttccactttgacctcatagttaatctgcgtgatagttaatcacgcagagtctctagtgatttttttcctatttattttaaatacacacacccacagggctctgccccctgtaaaagaaaaaaaatcaaaacaaacaaataaataaccccaaagagatggacccaggggagaacgcgtaagtgtgaggggcatgagtatacacgagtgtgcgtgtctttccctctcccttatttgtctccgtatgagtctctccttgtaccctccccctgcctcgatgatattactcccccagacttggaagccgctgccagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgcattctaatccatggtggcatctcagtagtctggtgggactgtttgtcttagagattgtgacctctctttcctgcctcatttccccaaatcccctctcagtgagctttatctgtgagctgtgtgactgtgttttgcatggcggtactcttcacctcaaaaaaattaagagaggcatgtgggttgtagagtgaagaagaaaggcagacatgtaataaagtaagtaaaaattcaagtcttctctacctcaagaatttcggtgtggttaacattaattccagtgccagacaaagttgggatcccagctttactatttaccagttgttagacaattgtcaattcagactttagaatcctccattaaaaataatttatgtatttgtttatttgtttagagatggggtgtccctctgtcactcagtctgaagtatagtggcacagtcatagctcactgaagcctcaaacttctgagctaaagcattcctcctgcctcagcctcctgaatagctggaactacagatgcatgccaccatgcccagctagaagtctccattttagcagctataaattagatataccaatgctaacctatgtagtgacactcaacaaatggtcaaaagctctctccctcacttccgatgccttccatgcactgctgtcatgctcccttcatcctatcaaactagcttccctaatagaatccagcattaggcatataagcctttaagtgactctacatcactctatttttatttttaggaaatatttgcattgcaagtcttttaaactatatgtgggaaatttctgtctcattggaaaaaaacttacacattacattagttatttttaaggccaaagaactgttatttgtaccctcaaaatttacaaacatacaaagttgattagccctactccagagacaatgtcatgttttcttgaactcttttgaaattctcccaggaatataatattatcttcacaacacagctgccctaaccatccttggccccattctcttggcccctcatatcttcctgcatctaatttaatcatctatttctcaccttccaaacctataaaaatatagttttcacttagatgttgtctgctgtctaactcaatgccctgaactttagctgaattcatatctttatatggccttcattccttgcattaagtctcaatattattctgactagtagcaaaaatttttgtctgcaatgaaggtcaaattaagttaacaaaatgatgtggtcttcagggattatgtcaaaaattgctatctctatgctttgtcactatgaatctttgtcaaaggtgtagaatatgggggaatgacgtagaccaagagctcggctatgttttctagtgctcagtgaactgccaaaggtcacacagctagttaatgacagatcagggggtcatctaagcattgctctttccactgtgtctcacagtatttcagaatttagaagtaaaattctggaatactttatctttctgttaatattttaggatctgccaaactgcaggatgctttccttctttgatctaagcctcactttgactcattttattgcaatgagacaggaatttgagaatacctagtaacagagggaagtcaatgggttttgtatttattttattccttctcatgtgaaatgaccaattgatatttaatattacccatactgctttcagaatgctgtttcaaagaaacatctaaacaactccagacctagagttagcctttgtcctttgggatatgtggcagtagacaaccaaaaagtttccatggctaggatctgcaggctcattctttctactatttaagcaaagtggtggggaatgacctaactattatgattctttctaaggttacagattataagccaattgcaaaatccagttgtaactttcttttgccacattttggataataaagaaatagtttcctctaattatggtttgtgtaactaattggaaaagcagaggctcttgctccagattaactaggttcaaatatcagccctgtcaacttttgtctgccttagttttctcacctgaaaaatggagataatattggtgtgtatctcagactttattataaggagaaacttagttaataccaaagaattactggatgctagtaattttcctcagtaaggatataaagtttcagaaaatacagggtacaagaaccatatctactttgcttaaaaatattgatcatcatttgtgaggactctcttttctcataaaaaaaaaagtcactggaccggggatagaaatttcatttaacatctggggatttccaaatattcctatcttgatgatattcagtttcttacgtaaacaagggaatttggcccctttttctccagcagatttttattcgatcacttctctgctatttgctatggcctgatgtgattgattaccatctaacattctgactctattaaactctgtcttatctccatacaggtatcttggctcatttatcttatttccaccctgagacttctctaaaaaagcacaattttcctagaatgtcgtcctctgctcaacagattcaacagtctctaattaaagactctacctggtctgtaaggtcttcccagtttcactaaagttcaatatgctattttcttttatctcttccagttcttgatgtgacttttgaatggcctaatcctaatgtttatcttagctaaatacttacattcatccaatcctctttgtaaacaaacattaaatgtacaatgctgtgacaagaatatattataaataattcactatcaattggcatcttaaatcaggttgtttatcttctatctccatgctctataaatttgcctcgcagtttttttttttctgagacttgtgtgttttatgggtgtggaattaagttcctcatcaaataggttttaattaagcatctatacattcagcttaatataaagttttcagtaaattcatgccatgggcctaatatagggccctgtgagtgcaggaagaggtaaatttcaggtatgctttgccctgaaatgcccataatatgatagaggagtcagaaaagaatacaaataactctaatggagctgcacacaagtagttgtagatagaataagtcatattctaactgtgagtgaagtcagaaaagggtttctctgtataaaaagcattcctctacatgtaaggaggtcccatcactgctcaaaatccccctttctgtaattactaataaaaatcctatagactatttgaaaactatgtacatgtacataacaatattgttcttaatccattagcaagagttagtcactaaaatagtatttatctttctatttttgttttcctccatatgtatttacagctgagggttttttccccacatatatttaaacacacggattagacaggtgaatagaagtatagatatggacatacatctgctttgaagtctcatttttccacactattatatatgtgtgtgtgagtatatttaacataacattttctggctttccattattatatcacaggactgtgtcataatttatttagtcaatcctttatttctgaaaatttgcattatttcttatttttgttgctgtaagtaatattacaaaactgtttttgttgctataagtaatattacaaaaatatttttgtcacaggcatatatatatattcctctattttcatagaatatatccctaaaacatgagctttgctgaattaaaatgtataagcatttaacaattagagtcctgacagaaaacaaatggtatactccaaggagtaattgaagaaaaattaatgaagggttacttacaaagattaggcaaggttaaagtctaccaattataggatggtttagtacaacaggtctagcagttgtcaactgaactagttacctatatccgttgtacaaatttcaatgaactcagtgacttagaacaacaaaaattcattatcataattaatttcagaaggtcagaaatttcagtggctgaagtcaagatgtgagcaaggctgcattccttctgaaggatctaggggagaattaatttcttgacttttccatgttctagagtcctcttgaattccttggcttgtggctcatgttcacctttaaagcaagcaactgcatcactcagtccctttccttcatctttcctctggctctgacctcaagcctcctacttacaaagacccttgagattacattggacccacccaaataatccaagatgatcttgtcttcagatccttaaccatgcctgcaaactcccttttaccacgtaagatatatgtacagtttgcagggattcgaacaaggacatttttggggacctattattttgcctaccacactaccttagtcattaaagtacaaaaggaagggacagttacaggacctagaaagagctgtagaacaggagccgtgactttaaactaatacaaccactgcccaacagcggccagtcaaggagggagagtaggaataagtaatcagaattctctcttctcctacctaaagtatatctaattggtcaaagcaaatggaaactagtggacagggaaatgcagatagggtgggccagaggtcagccttatggggcacaccatgtggtgaagaactctgaagaatggatccagagaaatgactggaaattatccagaaaacctctccaaaaatcagcataagtggtacaaaagaaagcttctttacttgtaccctacttaacataaatttctgaaataaagaagaaatttagggttttcaaatagatttctatgccatggaaaaagtagtctttaaaagttattacactggaatattacagatccatatattttatattgggtaatctgttcaacctgaagaacttttcaataggctttaaagctataaagcaaatgcctttatacaacactttctgggagttaatgtgggttaatagacatgcccttctggtgagtcctgtggcaagggtgccaattcagtcagtgatttgcaggccacagcaccctcgagctattttcacgaagggtggaccttctgagccaatatttctcatctgttattgcagaacttaaaaagggacagggcttctgagtcactgagagcccaagggtacaattctatactgggttcaaggctgaaaatagcaaaaccacagatctatttctgtaaacacaatgactgtaaggacaactacaacttaatttggacaacttaaactaaagtgactaaagcaaaccatttggaaaacagactagcttagtactgacactctgaacacagcctcttatagtgtacaagactatgactttctcattgacagccttcccatcctcttaaagtcatgggggaaactgagtccttattagggctagattgtgaaccctgttgaacaaaaaagaaggacaattttacacggcacttaaatttagctattctcttctaaacctccattgattctgcatctcccctttcattctttcaatctcttttttttcttcaaaaagacttgatgtcactgtgaagcaatgaagatgtgattcaattcaataagtatgttgagtgcctaccatatgccaagaactgccctatgcattggagatatcttggtaaaaattaatggctcaggccctatccttacagaatttacaatataatgcaaaaagaggtgagaaatgtgaaattcagtgggtggttagtattattaatgcagaggtaaacatctgatcacaaaagcctcacccttccccaaattctgtatatataaatgtatggggtaggcttaagctgatattcttcaattaacattaatagatttatttcttagatatagaaaataaacc

SEQ ID NO: 8060 - DNA, 3600 bp, Homo sapiens
  ENST00000639683
atagttaatctgcgtgatagttaatcacgcagagtctctagtgatttttttcctatttattttaaatacacacacccacagggctctgccccctgtaaaagaaaaaaaatcaaaacaaacaaataaataaccccaaagagatggacccaggggagaacgcaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccc

SEQ ID NO: 8061 - DNA, 5360 bp, Homo sapiens
  ENST00000639384
cagagtctctagtgatttttttcctatttattttaaatacacacacccacagggctctgccccctgtaaaagaaaaaaaatcaaaacaaacaaataaataaccccaaagagatggacccaggggagaacgcgtaagtgtgaggggcatgagtatacacgagtgtgcgtgtctttccctctcccttatttgtctccgtatgagtctctccttgtaccctccccctgcctcgatgatattactcccccagacttggaagccgctgccagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggtataatgtttttggaatggaaattcactgcatgcaactgctaaatttaactattaatgcttacatggtgttttattttgttttatgagtagacatttaagcattctactagagataatatgttggagaaagttctacagacttctagagttgattcagcaactatacactaattcacataggttttaatcttacaccaagcccaaaagctataatccctgtgagatgtcataggtaaagaaggctgctttatccatcaaagccaaaatgagcttcctcttttcagatgaaaatgggattgagtcttactgattacgactaccaagtttgtactcttttaaaactaaaatttaactctgtaaatcttaattcaaaatgtattggttcattactgtttgtaaacttaatgatttctgtttttctgaacactacctgtaagttctgtaagaacaatattctttttgaaaggctttgagttaaaatatccattccttatttccagagtgatccctgagccttttggctctactataatgtgttgcaatgagatttctattcaaatataatagctgattctgagacgttagaatttctgtttagattatgctaaaatgaaatcatccaaattaacattaaatatatcatttagttgcatagaaatttaccaactggtctagcaggaaatttgacaagtagtaaccttcttttctcaatttccattcacatgtaggtaaacattgttgacattcttaagcttatagatggtgaatattagaaaaagaatcatagtcctttaaaacataagccataccattgtggtatacaatcaggaaaattctgtatttatatatattttaacattttctattaacatttaatacatttgctcagagtaatgggttttctatttgcctataactaagcatgacacaatatttgatttcagaattgatgcatttttatttctctgttccactcacatgcagcaccatcaaatgccttcatgtaaccaatgtcacatctaatacttactagaataagattccatgtaatttgatttaaatatttaactttgagttcttttggtgttcaatctccttgctatagctattagcttgatgatattattttcagctgcactgcttaagctcaaaatttgaaatctgcaaatgtgctatctttctaagttcaattttaccattgtagatcatgatgtcatagcaatttcctgagtacccattttcagattcatcatcacattggtgacattgtggaaaaacagcctaggatctctcgagaacaactaactgatccctctccttccctaccctcgtcccaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaa

SEQ ID NO: 8062 - DNA, 3086 bp, Homo sapiens
  ENST00000640985
agtgatttttttcctatttattttaaatacacacacccacagggctctgccccctgtaaaagaaaaaaaatcaaaacaaacaaataaataaccccaaagagatggacccaggggagaacgccttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatgg

SEQ ID NO: 8063 - DNA, 7669 bp, Homo sapiens
  ENST00000638772
ggggagaacgcgtaagtgtgaggggcatgagtatacacgagtgtgcgtgtctttccctctcccttatttgtctccgtatgagtctctccttgtaccctccccctgcctcgatgatattactcccccagacttggaagccgctgccagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgtatgtatcattttccattggcaccattgaaatttttatgatttcggtttagtttgttttcattagcctatctgcaggctaaggctcagcagtttgggctccaagatgaaaacagcatgtatgagtttagccaggccataacgattcatttacagtcattagttacttgagagagactcaagtctgtttctattttctgtgtcagagttcttatgcaaatataattacctgctctctttattttgtggagactaaagccatttttgagaaatgtgaccttcttcttgttgctattattccaggtttcactgattttttgagatggagtgtcactctgttgctcaggctggagtgcagtggcgggatctcggcttactgcaacctctgcctcctaggttcaagcaattctcctgcctcagccccctgagtagctgggactataggcacacgccaccatgcctggttaatttttgtatttttagtacagacggggtttcaccatattggtcaggctggtctcgaactcctgacctcaggtgatccacctgtctcggcctcccaaagtgctgggattagatgcgtgagccactgcgcctggccatgataatattattaaatcactgatattttaaattaaaacttccatctcaggcattccactaggaagctataaggtccttgaagtttcaaggctgactacatttttgcaaatgatttagtgtgtgtatggaggtggaatgtgggtattgtcaccagataatttctattgatttcattctcgaaatgtatctttttgtttttaaaacaaatgatttactattatatgggcaagttagttagcctccttgtgtgttttatatatatatatgtagtgtattatttaaaaacacttgtcttatggggctcctatgagaaataaatgtggcaatgaagggcaaaacaaaaaatcccaaaatattacatagtactctacacatgaatgtacttaacattagtagttggtgatgatagttgattttgatgatttatacagtttccagcctggattgacttcagtgccacaatttgaaaacagggaggatgacttctacttgcaaccaaactttaaatagtgaggatgaagcataaacacaaatgcctaaagcaactgttttttattgtgagtgttgaggagagcacatagttacccatttacacacctgaacaaagtggctggctcatagaaatccccatgaaagttaaggtccattcccttccaagatatgggcaaagagaatcacctgacaatcctggatcatggccttctgctttgagagccgtaataacgctctacctatccaacccagagactttggaggttgaattgtaaggaaggaatttagctgattctaggttgtattctgatgcagctgcagaaacccaagtgaaatactacaagagtaatgtgtttatttgaatgtaagactttggaacatggaaagaaagaaacatcattattcttgatttaaaaaatgctttctttaattgctcaaatatttacaatgctttatgcagtccttcccttccctgtctgttttgcctctctctgactttccattttctctatccttgttttattttccttgttgtgttgtttttgtttgctccctcttgttcactttccatttcactctccctcaagaaggtggttctattgagagttggcatattacctgccagctataacaaggacatgaggactggctttcaaacaagttctgatgagtcctttggaaaaagccccttggccctctctgtcagctacgccattgcagagtagattttgttgcaaagatagaggcagattcccttattcagggtcatggaaatggcagaagaagaaaaggcagaggagaacaggataaaaatttgagaaaatgaaattacctgagaatttcatgcacttctttttaggcaattagatgattcatcagaactagcaagaaaataaactaggaatgagaagctgaaagtttattttcctgtttaatatgccttttggataattgtgtcaagactcacctattaagttatccgtgatgataattagaaaatagaatcatagtatttttaaacaggggaaccaggcaatagaaaacttccttgcaattgaacaactctggcttcttcagtcaagtaattgtagattaatttattaaaaatttcactagtaattacaaaattacacttaactttaagcaaatactttatcccaagctcagaactctccttctgtgtttataatttcagttcatttcacttactgtgttttcaaaatgtatttttaatttatcttgtctctctctttttttttcattttttttctcctttttattaaaaacaaatgcaattctcttttctgtctacaaacccaaagcttcttcggatgttttccttcaaggtataatgtttttggaatggaaattcactgcatgcaactgctaaatttaactattaatgcttacatggtgttttattttgttttatgagtagacatttaagcattctactagagataatatgttggagaaagttctacagacttctagagttgattcagcaactatacactaattcacataggttttaatcttacaccaagcccaaaagctataatccctgtgagatgtcataggtaaagaaggctgctttatccatcaaagccaaaatgagcttcctcttttcagatgaaaatgggattgagtcttactgattacgactaccaagtttgtactcttttaaaactaaaatttaactctgtaaatcttaattcaaaatgtattggttcattactgtttgtaaacttaatgatttctgtttttctgaacactacctgtaagttctgtaagaacaatattctttttgaaaggctttgagttaaaatatccattccttatttccagagtgatccctgagccttttggctctactataatgtgttgcaatgagatttctattcaaatataatagctgattctgagacgttagaatttctgtttagattatgctaaaatgaaatcatccaaattaacattaaatatatcatttagttgcatagaaatttaccaactggtctagcaggaaatttgacaagtagtaaccttcttttctcaatttccattcacatgtaggtaaacattgttgacattcttaagcttatagatggtgaatattagaaaaagaatcatagtcctttaaaacataagccataccattgtggtatacaatcaggaaaattctgtatttatatatattttaacattttctattaacatttaatacatttgctcagagtaatgggttttctatttgcctataactaagcatgacacaatatttgatttcagaattgatgcatttttatttctctgttccactcacatgcagcaccatcaaatgccttcatgtaaccaatgtcacatctaatacttactagaataagattccatgtaatttgatttaaatatttaactttgagttcttttggtgttcaatctccttgctatagctattagcttgatgatattattttcagctgcactgcttaagctcaaaatttgaaatctgcaaatgtgctatctttctaagttcaattttaccattgtagatcatgatgtcatagcaatttcctgagtacccattttcagattcatcatcacattggtgacattgtggaaaaacagcctaggatctctcgagaacaactaactgatccctctccttccctaccctcgtcccaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgccta

SEQ ID NO: 8064 - DNA, 2827 bp, Homo sapiens
  ENST00000639424
gccagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctgggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagt

SEQ ID NO: 8065 - DNA, 3927 bp, Homo sapiens
  ENST00000414552
cagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttggtctcgttctattgcccaggctggaatgtgcagtggtgtgatctcggctcactacagccttcgcttctggggctcaactgatcctcccaccttggcctccagagtagctgggatttcagatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgcattctaa

SEQ ID NO: 8066 - DNA, 1264 bp, Homo sapiens
  ENST00000639549
agagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggaggtttgttaaagtcttttgcgttgtgctatagataggagcacataaacatgtctactttaatagataaaacatcagtgtagttcaagagcaaggaagatttaaattatacttttttatatgttgtaaaagtagtgtttaaatagcattcaggcctatgagtgggagaggtgtcaatacattcaaaatgaagaaatattattttcaagtgaagcttgagagctagagttagaaattcacatattgctagatatctcagatagaagctgtaggaaaaaaaaaacaatgacccctttatgaagcaacataaacaaatcaaacaagacaataacagtaaagagaggatatattgtttgcctgtttttgtgtaacaaacaaccagaaaatctcaatgacatatgacagtaaacatgtatataatactcccctcagagatatactaatctatgctaaagcaagctggagctgcttatttagggcaactgtactttacgtgttcctcgttctactcttgggaccagcaggtagctaggacaacccttctcacagtggtagaaaacagccagagagtaagtagaagctcatgaggctgaatgcttaggcctagcactggcacactcgcttttgtatatatattattagccgaagccaatcagatgatccagcccaaagtcgagaggcagaggaatagccttatccaggagaaggcaaggatgtgaatgccggttatagagaattcagtccaccacagtgagttaggacatgacactttcaaggaaaaaaa

SEQ ID NO: 8067 - DNA, 2145 bp, Homo sapiens
  ENST00000522990
tgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatgcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattat

SEQ ID NO: 8068 - DNA, 3767 bp, Homo sapiens
  ENST00000361925
tgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttggtctcgttctattgcccaggctggaatgtgcagtggtgtgatctcggctcactacagccttcgcttctggggctcaactgatcctcccaccttggcctccagagtagctgggatttcagatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgccta

SEQ ID NO: 8069 - DNA, 1581 bp, Homo sapiens
  ENST00000638782
aaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtgagacacctttgtttatgttgcagtttctcaagataagtaccaaatacaagtaatttttatgtccatttctatgttgatctgctttaaatttagcctgcaattgcatagaaataccatttgtttcatattcaagagaactggcatttttaattcacaatagcaaagacttggaaccaacccaaatgtccatcaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacactgcatgttctcactcataggtgggaattgaacaatgagaacacatgcacataggaaggggaacatcacacaccggggcctgttgtggggtggagggattggggaggaaaagcattaggagatatacctaatgttaaatgacgagttaatgggtgcagcacaccagcatggcacatgtatacatatgtaacaaacctgcacgttgtgcacatgtaccctaaaacttaaagcataataaaaaaaaaaaaaa

SEQ ID NO: 8070 - DNA, 3628 bp, Homo sapiens
  ENST00000641017
atgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctattcatcatcacattggtgacattgtggaaaaacagcctaggatctctcgagaacaactaactgatccctctccttccctaccctcgtcccaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggactttt

SEQ ID NO: 8071 - DNA, 924 bp, Homo sapiens
  ENST00000640910
ctactcgactcctgtattttcacagaaaatgacggtgtggattctgctcctgctgtcgctctaccctggatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtct

SEQ ID NO: 8072 - DNA, 1923 bp, Homo sapiens
  ENST00000523372
ctactcgactcctgtattttcacagaaaatgacggtgtggattctgctcctgctgtcgctctaccctggaagaaaactttcttcttacccacataaattgagatttgaaaatgaatgaagaaaaacattgatagaaataacctcaatatcaagttggagatcctgacagagctaagtcatgttctacattcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaaga

SEQ ID NO: 8073 - DNA, 3534 bp, Homo sapiens
  ENST00000356592
ctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccgaagataagctacatgaaatcttggtgaatttgacattgggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaa

SEQ ID NO: 8074 - DNA, 3069 bp, Homo sapiens
  ENST00000639554
actcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggtattcttttgcaaaaggaaaggagtaattgttaggaagaaaacaaacaaacacaaaaatcaaccttaagtctctaaaagaaaaaaaaaaaaggaaataaatttcaagactgcatcagggttggcatgctatcaattagtatatgacatcaaaacattagttttttctttttgttatcaatgagctttttcaaagcactaattataggcaaagcttattttccacaactgctgtgaaaactattttttgtcacaactgacctgaaatttcctttgtcttgcaagatcatctgacctttgcacctacgctttgcactcttatgcttggcaatatcttcatttccaaggaaatagttgctaaaagagaatttttgaggtgtatgtctccatacatccttctctttttagcttcacaatagcaggcacctagaatctattatctttcatctcctggcaccccacttcccattatgttaataggctatttaaattaatttgttgtctatcttgggaatagacatgggagaaagttgaaggagctatggttcagcctctgaaattaaattctgaaattaaattgtgaaattagagtaaaatgctaccttaataaaataattattttatgccattaccttagcacttcatactttgcatttaaaacatttttacattgaattttctcattggtgggaatacattattagacagaataatagataagtacatagtcttacgaatcagacatccgactttggttcttagctctctctcttactatctgtaggaactagggcaacgctccagcatttctatataaagggacttaggggcagctatctggtagcaggacttttagtgttagaagctttgtttgcatagtaagcatgatgtttttacatggttatgtttttatttagaaaaattaagtgagaactgatggaaattattgggaaagaaagcacaaccatgctgtcccaccctgtactgcctctcccccgaccttgacatcacaactgagcaaactcttttacctttcatttctttaatttctataaaacagatatagttcttctgaccttacggagttgctataaggacaaaatagggtgataagtaaagtgattaacatagagcctgatatatagtaaatatagaaaatattaaaattatttatacattttcaatcaaaataagaataatgcaattctaaatcttcatatcaaatgattcatgttaaatgtgcttgctcaacatacaaaatataatacttgaataggctccaaaatctttattaattatatcagttattagaaaaagccacaattccaaaataaattcattccaggcattttatatttatcatggcttttgtaaacttagagatatagtaatgactgagtttatttttatttatttatttatttattttgagacagggtctcactgtgtcacccgctggagtgcagtggcatgatctgggctcactgcaatctctacctcccagaggttcaagtgatgttcccacctcagcctcccaagtagctgggaccacaggcacgtgccactacaccctgctaagaatttttttgtatttttttgtagagatagtcttactatgttgcccatgtggtcttgaactcctaggttcaagcggtcctcaactcagcctcccaaagtctggggattataggcgacagccatggcatctggccaatgcctgaatgtagaatctagtgggtacaaaattcgcctgatacatcagagctcagtccagcttttgaaatatgaagccaatcatactatctcaagtgtctttattgttcttataacattgtagtcattttgggacttaatttatggaatcattacattagttagttatgaaagccacctcaaaagtgtcactaatggagattcaatcaaagcttgaatggttaccagtctacatagagagatgattttgttctggctatctaaaatgagctatgagtgtgtttgtgtgtttttgtgcatgcccaaagacatttagatctgtatctatgtttgtatctgcaattatattattttcaattttaataattccagtttaatttggagtaataatactaataaaatatcaagtttaattgtagcttcctttatgaataaaactattcttccctttgaagagcatataaatatatagtaacaatgattaaaacctccagctttgaaggtagataatcttgggtccaaatttcaactgtgcctcttgttatgtgactttggacaagttcaggtacaataaatgcataataatacttattaaatgaggaagcaattcactctacccagtgcttcatagttaattaaggtctcaataattattagatatattttaacatcagtaattgctccgttatatcatagaatgatagattcttaattctgttcaattaaaaattatactaattagaaaatctcttaaaaataaattttcctaaaataatactttccttacatcaataatatctgtacaatgtaagagatatagctaaaaatatgaaattttaaaaatcatca

SEQ ID NO: 8075 - DNA, 8487 bp, Homo sapiens
  ENST00000640739
actcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttgtaagtaatattccttctccatttgtatcctccctcacctacagtctttctgattgccatgttaattaattgaaagaagcataacaaatttcaaagttgtattaagttatgttactgacttcgatgattttgaccatctctttcatcttaatcccagcttgctccgattagggtgattcctgcaaaagaagggctgattttattaagaattacaataggtttccttgagttgcaaacttttaatatattggttgcatagagccttttttttttttgtaagggattgtaaagccaaccctggactcaatagaaaaggtgcaatctttaattatatatcctcttcctttctctcctatgggcctaggaagggactatagcagcacattgctagttaaggcctgccccacaggacaattatttcattgataaaatatatgtgaactactacttgacacacataagatcaaatataaaaccattatttttacatttattatttttatcagatagataatagaatgtagcaagaggatccatgatgatctaacacagattatgctttagtaacctttacaaatatttcctgcctgaatcaaagccaagcaaacctaaatttcccaaaacattttccttactatttgttcagcatccatgaaaggtcaattgcttcttttacattttttgtctgccagttgtacatattggacagaataaaaatctgattatagattttaaaagtatgtttgtagaaatgtaatttctcaaccagggagtccaccaagtcatagtaatcacagtttgaaaaacgttgatgatcagagaagtaatcacctgtttatcacttcatcaataccagaggaaaccagaggaaaaatatcactggacatcatatttacctagaaaaattctcattataaaacttatttcatgttttcctgaatccaagaatgaaatatatttaattataaagttaaagcttccctgtgctttagagagataagccttcctttcttttaatactccaattgggactacttctttcttgcgtcagctaaaattcaagaactgttgatttctctgccatcaggtggccagttgaaaatgatcctctgaacccaaacacaatttaatattactcattgctatcagaataattcagtcaccagcacattctctgcctcatatcatcatttttgttgttgttgttgttgttttgttttgttttgttttggacagggtctcgttctattgcccaggctggaatgtgcagtggtgtgatctcggctcactacagccttcgcttctggggctcaactgatcctcccaccttggcctccagagtagctgggatttcaggcacgcaccaccatacccagctaatttctgtattttttgtagagatggggcgtcgccatgttgcccaagctggatattatcactgttttcctcaattttcatcacatactatcatatctctctccatcccctccatcccttctagggactctctcttttttttcctccctctttaattaatataaacatataatagataaagctgcatcaaaaggaacagaaagggggaactatgtgggattttattccaagtactcaatcagtgttcataatcaaactaatctttacatggcattattatttattatcacataataattagtattattagtagacaaactgttaaaatgatttctgatttttatttattttcttgaaaaagttaattctgcagttgacttcataataatgtttatccattcaacaaatatacattgaccatcaattctgtgagataagtactattatcctccctataagaggacaaacaatttaggaggaaaaatatacacttgtccagggtagaatggctgggaaatggtactcataaccactactttatctcacctccccagtgtgatgtcttcaatgaatactctctgttctattagtacaagctcattgatatcttcctcttagcatttctacttactactgctttgaattgtgtatttctgtgtatattaaaatggagtcccaacaaattgagaaagaaagataataaataatttaggttacgttttccaactatcttccacttcaaatgcattctttggagaagttttgagtctgtactgtcttattattttctgtttctatgtgactcaaaatcttgctctgttaactgcctttcactgtgatacaagactttgtatttctactatttattatagactggtcacttggtatgcactattccagatgatgtaaagtatgcatatggcatatataaaatcacatgtagtataccttctatgtcatttaaattattttcaagagtaaatttgacctttggatttttgaatctaacttcccattaggatgcaaagtcattgcaatttatgttctcattgcaatgccctttggtccaagatcctcatttagcttgtaactatctttctcagtctttacctcagtgtcatgttcatagaagatggttgctacatatgctaatttataatcatttttaatgtgagctttcctatctcacggcagatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgtatgtatcattttccattggcaccattgaaatttttatgatttcggtttagtttgttttcattagcctatctgcaggctaaggctcagcagtttgggctccaagatgaaaacagcatgtatgagtttagccaggccataacgattcatttacagtcattagttacttgagagagactcaagtctgtttctattttctgtgtcagagttcttatgcaaatataattacctgctctctttattttgtggagactaaagccatttttgagaaatgtgaccttcttcttgttgctattattccaggtttcactgattttttgagatggagtgtcactctgttgctcaggctggagtgcagtggcgggatctcggcttactgcaacctctgcctcctaggttcaagcaattctcctgcctcagccccctgagtagctgggactataggcacacgccaccatgcctggttaatttttgtatttttagtacagacggggtttcaccatattggtcaggctggtctcgaactcctgacctcaggtgatccacctgtctcggcctcccaaagtgctgggattagatgcgtgagccactgcgcctggccatgataatattattaaatcactgatattttaaattaaaacttccatctcaggcattccactaggaagctataaggtccttgaagtttcaaggctgactacatttttgcaaatgatttagtgtgtgtatggaggtggaatgtgggtattgtcaccagataatttctattgatttcattctcgaaatgtatctttttgtttttaaaacaaatgatttactattatatgggcaagttagttagcctccttgtgtgttttatatatatatatgtagtgtattatttaaaaacacttgtcttatggggctcctatgagaaataaatgtggcaatgaagggcaaaacaaaaaatcccaaaatattacatagtactctacacatgaatgtacttaacattagtagttggtgatgatagttgattttgatgatttatacagtttccagcctggattgacttcagtgccacaatttgaaaacagggaggatgacttctacttgcaaccaaactttaaatagtgaggatgaagcataaacacaaatgcctaaagcaactgttttttattgtgagtgttgaggagagcacatagttacccatttacacacctgaacaaagtggctggctcatagaaatccccatgaaagttaaggtccattcccttccaagatatgggcaaagagaatcacctgacaatcctggatcatggccttctgctttgagagccgtaataacgctctacctatccaacccagagactttggaggttgaattgtaaggaaggaatttagctgattctaggttgtattctgatgcagctgcagaaacccaagtgaaatactacaagagtaatgtgtttatttgaatgtaagactttggaacatggaaagaaagaaacatcattattcttgatttaaaaaatgctttctttaattgctcaaatatttacaatgctttatgcagtccttcccttccctgtctgttttgcctctctctgactttccattttctctatccttgttttattttccttgttgtgttgtttttgtttgctccctcttgttcactttccatttcactctccctcaagaaggtggttctattgagagttggcatattacctgccagctataacaaggacatgaggactggctttcaaacaagttctgatgagtcctttggaaaaagccccttggccctctctgtcagctacgccattgcagagtagattttgttgcaaagatagaggcagattcccttattcagggtcatggaaatggcagaagaagaaaaggcagaggagaacaggataaaaatttgagaaaatgaaattacctgagaatttcatgcacttctttttaggcaattagatgattcatcagaactagcaagaaaataaactaggaatgagaagctgaaagtttattttcctgtttaatatgccttttggataattgtgtcaagactcacctattaagttatccgtgatgataattagaaaatagaatcatagtatttttaaacaggggaaccaggcaatagaaaacttccttgcaattgaacaactctggcttcttcagtcaagtaattgtagattaatttattaaaaatttcactagtaattacaaaattacacttaactttaagcaaatactttatcccaagctcagaactctccttctgtgtttataatttcagttcatttcacttactgtgttttcaaaatgtatttttaatttatcttgtctctctctttttttttcattttttttctcctttttattaaaaacaaatgcaattctcttttctgtctacaaacccaaagcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaatt

SEQ ID NO: 8076 - DNA, 3457 bp, Homo sapiens
  ENST00000638877
agaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatgcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctcttcttcggatgttttccttcaaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgcattct

SEQ ID NO: 8077 - DNA, 3058 bp, Homo sapiens
  ENST00000639046
agacaaaattgcacctgtttaatgttttaatgtcctgtattatgggcaaaaagagggattttatttgcaagtaataatttgaacagggttgagtgatgttcttggcagatggcacatcctttctgctgaacctgttaatgtcagcctgagatggactatgacctccacaaagatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattg

SEQ ID NO: 8078 - DNA, 429 bp, Homo sapiens
  ENST00000640757
accctgcttcggctcgcgcatggtgcgcgcacccactgacctgcgcccactgtctggcactccctagtgagatgaacccggtacctcagatggaaatgcagaaatcacccgtcttctgcgtcgctcaggctgggagctgtagaccggagctgttcatattccgccatcttggctcctccccccgcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttg

SEQ ID NO: 8079 - DNA, 10768 bp, Homo sapiens
  ENST00000615808
gccgcccggttgcgcggaccggcgctagtgcgcgggtgggggcggcgcgccgcggtggcccggcgtcccgtgtgcgtccagtgtgcgccccgcgggggcgcggccagcgccagagtagatacctgtcccgcccgccgcggccagcagcctcggaggaagccagggcaaagagggccggcggagaccaggtccgcgccggaggaagccgcgcccggccgaggccccggaccctgcgccccgagctccacggcaccatggccccgaagctgctgctcctcctctgcctgttctcgggcttgcacgcgcggtccagaaaggtggaagaggatgaatatgaagattcatcatcaaaccaaaagtgggtcttggctccaaaatcccaagacaccgacgtgactcttattctcaacaagttgctaagagaatatgataaaaagctgaggccagatattggaataaaaccgaccgtaattgacgttgacatttatgttaacagcattggtcctgtgtcatcaataaacatggaataccaaattgacatattttttgctcagacctggacagatagtcgccttcgattcaacagcacaatgaaaattcttactctgaacagcaacatggtggggttaatctggatcccagacaccatcttccgcaattctaaaaccgcagaggctcactggatcaccacacccaatcagctcctccggatttggaatgacgggaaaatcctttacactttgaggctcaccatcaatgctgagtgccagctgcagctgcacaacttccccatggacgaacactcctgcccgctgattttctccagctatggctatcccaaagaagaaatgatttatagatggagaaaaaattcagtggaggcagctgaccagaaatcatggcggctttatcagtttgacttcatgggcctcagaaacaccacagaaatcgtgacaacgtctgcaggtgattatgttgtcatgactatatattttgaattgagtagaagaatgggatacttcaccattcagacatacattccctgtatactgactgtggttttatcctgggtgtcattttggatcaaaaaagatgctacgccagcaagaacagcattaggcatcaccacggtgctgaccatgaccaccctgagcaccatcgccaggaagtccttgccacgcgtgtcctacgtgaccgccatggacctttttgtgaccgtgtgcttcctgtttgtcttcgccgcgctgatggagtatgccaccctcaactactattccagctgtagaaaaccaaccaccacgaagaagacaacatcgttactacatccagattcctcaagatggattcctgagcgaataagcctacaagccccttccaactattccctcctggacatgaggccaccaccaactgcgatgatcactttaaacaattccgtttactggcaggaatttgaagatacctgtgtctatgagtgtctggatggcaaagactgtcagagcttcttctgctgctatgaagaatgtaaatcaggatcctggaggaaagggcgtattcacatagacatcttggagctggactcgtactcccgggtctttttccccacgtccttcctgctctttaacctggtctactgggttggatacctgtatctctaagtgttgctcagagtgaagagtgaagagcatttggtacacacttgaccttctgtcgtccccagaccagtagtgaccaatcgggagtagcaaggaaggacactgcccagtgtatcttgttataaatgacctttcagcaacacaggaagtacccagcaaaggtttctattatgtattttacacacacacatacatacacacacacagctaattgagttttaaagtaatattcttgctaatccctactgaattgtagcttggtgttgtttctgaatggtttttggatattggaagcagccgctgattacccttgcaaagaaatctgtaaaatgtgcacgtgaatgtctgagatgctctctcaggcctctagtccttctgtatctttcctttgcagccctgggtgtagtagcactcaggagtgttgaatcacccctggccgagacccactcctgctggctcagcctgggcatgtgtgtgctccagtgtgaacagcagtgggttccaaccccagtctcctttctctgtggcctctctggctccagcaccatcatcgttagctggcactcctttacctaataacctcgttctaggcctggggagagtacactcgcattgtctacggtttccattggaggagaaaataagattttcaaaatgctcatgttgttggggtcaaagatgattatctctgaacatcagaaggttattactttattccaacttactgagagtcaacaatatttgaactttgggttcttggactagttcaacagcatttcaccttaagagctgtttttcactagaccaacgctcaaccctcgagtatgtgtccagcttatgttatattattatgggttcggtaattgtcattttgcaaagaaaggtatacagtgaacacaacctgttatcttgaagacatacaccggaatgtgaaagacatgtagataaaattttatttttattttatttttttgagacagagtcatgctctgtcacctggccaggctggagtgcagtggcacaatcttagctcactgcaacctctgcctcccatgttcaagcgattttcctgcctcagtttcccaagtggctgggactacaggtgtgcgctaccacacccggctaatttttgtatttttgttttttgttttttgggtttttttagtagagacggggtttcaccatgttggcctggctggtctcgaactcctgacctcaggtgatctgcccgcctcagcctcccaaagtgctaggattacaggcatgagccaccatgcccggccaaaattaaaaaaaaaaaattagtgaatattaattttcaactcaaaccaactttagatgcaaaaaaatgggcaatggtgatcatcaagtacatattttgatgaacaagattattttatactttgaaatatggatacatagcaaaatcccaaagaaaaaatatccccccaaatcaatactcttttgatatttttataatacaaaaccaacttgctgcttgctgttagttctttgttataactggatgccaatgtgaactgcagaagactgttttgaaacttctcctcaccaataggcaaaacacaagtcctaccagttagttaataatgctttggcattgttaaaatttgaaaccagaatctctgtgcttctcatctttctcacatagaaaactgaattaatttgacctagaaaccgtaatttttaaaattatctattgtgcataccataattacccagaaacgtaaaatattttgcagagaaagtatagaaaagtatcaatttcacacaatgtcctggatgtataccagacacagaagaggatgggagcagaagaggccagaaaaagtgaaattagattcatctgcttattcctattaagattgttgcatattaaacggatgcaaagatatagatatgtctgaatttccaaagatggagtctatacagcgtgagacattcaaacccattgtttctctccctgtcaactctctgtcttttggtttggtagttgctacataatccacaagccaattggcttcagtttagcaaattcagttttaaaaataaaagagtatttgtggagaaacaggttgaaaatattgtcttagatgcaatgtctcctctattggagaatttcacactctggtactctagttctgtctctcatgcataagcaacccccgccttggcagaagtattctgcaaggaccctgaccaaaggaatccaagtcacaccacagcactgagcgccaagggaaggtggcccaagggcagtcttaagacacaatgtcaaacgttatgaatgggtaatttctaacaagctgaagaactgcaacctgctacattgtaaacgaagttctggagagaactgaattttctagaaaaattcttattgggaggaaaataacctaaaacaactttttataacatggatttgtttgattttaccttaaaagaattttactgatgccttgtgtttcaaaaccactcaacatttggatattgttagcaaccctcctgaaattttacatgtaggataaatacaccaataacctcagttttctgaatccagccattctcttcttcccaacctcagcagccctcctgatcaaaacagatgagttcagcgctccttttctaggaaggagaaccttcatctcaagaaagtccaatggatttcactaactgagcatcatagtgtggattcctgcatatacagcaggctccccactagggggtctcaataaaaagagctaaagcaccccctaagagcatgtccatgccgggttctccgcaggcttgcataattcaagttctccatatcagtctcaactcctgagatgagccttttcagtccacaatgaggaagagatgggtgtgccttggtgaggtgcagagctcaggggatttttaatcatgtacatgtttactttctagaggaaggagaggagcagtgtggggagagtgggaaggaagtacgctttctttcactaaagactctctttgccaggatgcctgatcaggagggacgtgtgtgggcacgaggtgcaaggctgttccacacagctaagccccagcttgctttgcatgcagaattgggaaatatttggggtggaagttgtctgagtgatctgcattccaaaggtgctactgtgttcctcactttcagaaatactctaagttgaggagatgacagttctgtattttgacatggaatccaaatttctgaccactgtggatcacacttaaaactgtgactgtctgtcttttaagctgcatactgggtggggggaaagcaaagaaaaggcatttcacattaatggaattggagaaaaatgtctcttcagagcctagaaagcttcagcttctgcaaagtcccaacaccacctaccagaacagagactccctacataccagacagagaaggacaaagttagtataatttactctggacccagccaatactgcccccaatttacccaaaacatgccttaaaatgaaacagaaagctcaaataatacacatcttttaagattttccatttcctgcagttagctatatttcatgccaagttttatttatcttttatgaatggatggaaataggatttcatttctttatatgccaaacagtcttacccttaattttacatcaaaccaattaagtacaaagattttgcaggctctttgactgagaaaatgcgtgttctcaagagcaaagcattttcactctacataagggaaattggggccaatctaaaatgtcagcaacacagtcctgatggggatgagtgtctctaatagaaactccgcaccaaatcattttacctggtgatagcttgctgcagtaagtttgcaggcatgttgcttcgttgttctgcaatataaccacactcgaagcaacaggagaggggccggtaacccattctgcattgactccagctccctatgactaggaagcaatgagccactctatctaaagggctagaacacaaaacagacaaaacctcttcttccttgatcatttttatctcagctgccaaaatggaaattttctgtgatttcctttgagacttgaagaattacacctggtctccaaccattattcttatcaccgtatcggttcagtgctctcaaggcacaaagcacttggaattcactccatgatcttgcaactctttttgagtgcttttcctgagcgattttaaactctacccgtaagaaatttcatctgcaatttctgtaaaaaaaaaaaaaaaaaaaaagaatggcttaagctccacataatctgatgtaaatatacattgaaacgttaagttctatttgtactgaaacactgtccaccttagactttagaacactatcatttaacagatattcagaaaggttccggaaatacgggggaaagaaccagactacgaatacattggaaatgttaaatttacaatattctcctgagcccccttccaatttcccaaaattgagaaagtgtgtaatctgtacctattttttttctcaaattggcctggaggaaacattcaggttcagagagtttagcagtgcctctatgtttgtgttctctgtgtaatcacatgaaagaaccaacaaataactcttcaggataaatgacacctgcatcgctgatcccttgttgacttatgttttattataaaaatagatctctatcattatagggataaaacgtgtatgttttgagatgatttggtaagaactcagccattcagtatttctggaagaattaaaaacttggctttctttttcttaatgtctaatagttttgaagactagatattagggcattttctttcctccttttaaaatttctactgattacaagctagcaatttcaggatatcagcttgatctagttgtattaaggccaaaaggcagactttctttatatttatttttattatttatttatttatttatttatttatttatttatttattttgagatgaagttttactcttgttgcccaggctggagtgcagtggcgccatctcggctcactgcaacctccacctcccgggttcaagcaattctcttgcctcagcttcccgagtagctgggattacaggcacccaccaccatgtctggctaattttttatatttttagtagagatgggctttcaccatgttggccaggctggtctcgaactcctgaccttcaggtgatccacccgccttggcctcccaaagtactgggattacaggcgtgagccaccgcgcccaacctgtatttacttttttaatgccacctagctgaataatgctttgggttttactgttgtcaataaaaccccttataccttttattgtcctgcttacttataaaagccaaattttaggcgaacttaaataaatcagtgctgaaaaactagttgaacaatcagtcactgacaagttttcaatgttttgagttaaccaagtgggcttttcagattaggttattcaagagcatgagctagaaaataattaggcagacaaaacatatgttctcacacacacaccacttccaaaacagacatgatttgaatgtagcattcaggttattgaggtgaacgtaaattgctttgcttgaacaattgagataatcacctactttcgccacttcacttttcacatttgtaaacacacacagggtttttccagcccagtgagcaggctacacaatgtgaggatgataatggttcctgcagggaagccagagcctctatgtctgccgaacagtttaaattgaacaggttggaaagaacattgattgccaataattaaatgccccagactgagcaggtagctgctacattttctcttctcttttctagttattcagggttccttctttgattttcatgagaaaggaacatttacacttcctgtgaggggcttagactccgatttctcccagttgcctcacttactgaagttcgatcccagtgaatgatgtgtatgtacccaacacatccaatttgtattttcttaaatatgtgtttcttaggtatctaaggatacatgagcgagcccacagcacaattattgcagtccccaagatgtcagtcttctcaaaatgacaacattgtcactaaccactttttaaaaaagaactgaaattcccattttttgttaaacgtttttccaatacatagcaatgtgtaaaatagactcccaaatctcctttgggaaaggaacctgtggaccctggagctaagttgtcattttagggacatggtgataatcaggactgatgccagtaagtgggaagttcattacggcaaggcagtgggaaggtgccagcatcccctttccacctgagatgggctgaattttcacccggaagtctgaagcctctggaagggcaggtggaatcgctcctggcaagggcatgaccgtgcacaggctgacatgattttccttttgggtggattggagttttacaactggattcattagcacacgtgtgggaacatgtgcctgtgcccacccacagcacttccttggaactctaagctgcttctctaatctaaggaggtctattcgaaaggatagtgcttgactttcaatttataaaagattattggaaacaccttaagtagtcctaacccactgtcagcttccaattttcaggagcaaatgatgactgctttgatttggttaggctttcttacaacaggtttttataaaatattgtttatatttgtaacaggaaggattttcaatgtcaatttcatccatgagtgaagaccccccactgcacagagcagcacttctgtcactctcatggggagatcagggtacccactcctctacgtagcttggcagacccagaccaccctgagccagcctgccacatccgctagtccatgcacctccagggtggccttgggagctacagagaggaaaaaaagaaaaaatgttgcattcttaagcaattaaagactccttccaatgtaattaaaaaataagtaatgtggcaaaagatgcacataacttgctccctcaagttctaaattgtcaccaaatatgaaaggtttttagatgaagtacatctacatcataaccatcatcaccctcattgtcctcttccatgtttctactagtactcagctattgattcaacacaaaggcttagagccttttctgaactataacgaaatcagaacttacatcgtggaaaaagcgaaaaagtttcattagagtttaaacattaagtatacagatcctactccaaaattttgctcgcctaaaacatttccagaactgctgtgttccccagcagtcctgcctgccctgcctcaatcagaatttcaaattactatttagaagaacattccattcaattgttgtttgttgattgctttctctctttttttttccgtttttaccttagttggctattttattccttttcgtaaagataacgtttgaattgtctaacaactatcttttttcactaaaatacatgcatctttggaaactgcaaattttgtgagctcaaaaagacaatcactgtgcttcttatcatctaatttgagtctaggctttgtttccccctaacttatcctggcatttttactttgaatagaaatagtcacaggcaaaatatattcatgaaatgtacagtgcttactattatatgatctctgtttagaataactattttattaaaacagtctaaaagacactgtccatcattcttgacatttgatatgtctaattttgtgctagtgaaccaagtttacctgctcacacgtttgtacaactacacaatgtgttttcctttacgtgcagctccggtactgagcaaaaggttcgttgtttaggagtgaaattttctgtgaaagttttgggagagtaattattttcagggatcagacctatgtgttgttaggagcaagaggccatcttgtgtttacatgcagtggtctgtgtatttgtgtctgtacgtacagtggtaaaactgaaacaacttattaataatgtgtgtcactctacccatcaccccaaatttagctgaaacaagtagaaaggagcgcagttttctagcgatagcgtattagcactaagcctctggttaggataaaaaggagcaagggagagggagaaagagaggacagagggagagagagaaagtggcaatctgtacatttcctgacaaagtgggatcatgttctttccaagaaaaggaaaagaaatccagcttcactacctgatcaggagtccctctggggtccacacaagcctgcctcctttggagagcccttgagcatcactgttgtgaccggggtgcacacctgggcgactccttgatcattcgtgcattctggtcaagttgacccgataagccaaaagtacttttcaagatttagatggcaaacagccatccccacccttgtctaggaagtcgtattcgcaggtcacaggaaggcgtcaggtcaggcttgaagcagccggggtgtgggcagggtcctctctctgtgaagcctgtgtgggaggtgaaactgtcaggggtcctgggagatggcccaggcaggaagggaaggagagaggcgcggactgctctctgttcccatggaatccttcctgcctgtgaagccattgtcctccagatgggaggtaggccgggagattccagaatccgaaaacattttggaatcatcttagagcaccggtgtggatgcgcttggccccgagggggccgcgccctgccccagtgcgtgcgcctcctgccccagcagggacccgccctcaccaagtggcctccagtagcccctgtgtccctgtcgtcccgcgagggattggaggccctggctccgggcggtcccgaggtcccgccgccctcctcccctgcgcagaggacgtggctccccgctatccgtgcggctcgtggtgtcctagtgaaatgagggcgcactggcgcccgacgtgccttggcgacacgggcggcgccgcgccccgcttcgtgcgtcccgtccccgccgtgccctcagctgggcctcgtggctgggccgccctctgtatttgtatttggattcctacgtttgtacttctaatacaaataaatgcacatgttgtcagaaatacctga

SEQ ID NO: 8080 - DNA, 1405 bp, Homo sapiens
  ENST00000555083
agagtagatacctgtcccgcccgccgcggccagcagcctcggaggaagccagggcaaagagggccggcggagaccaggtccgcgccggaggaagccgcgcccggccgaggccccggaccctgcgccccgagctccacggcaccatggccccgaagctgctgctcctcctctgcctgttctcgggcttgcacgcgcggtccagaaaggtggaagaggatgaatatgaagattcatcatcaaaccaaaagtgggtcttggctccaaaatcccaagacaccgacgtgactcttattctcaacaagttgctaagagaatatgataaaaagctgaggccagatattggaataaaaccgaccgtaattgacgttgacatttatgttaacagcattggtcctgtgtcatcaataaacatggaataccaaattgacatattttttgctcagacctggacagatagtcgccttcgattcaacagcacaatgaaaattcttactctgaacagcaacatggtggggttaatctggatcccagacaccatcttccgcaattctaaaaccgcagaggctcactggatcaccacacccaatcagctcctccggatttggaatgacgggaaaatcctttacactttgaggctcaccatcaatgctgagtgccagctgcagctgcacaacttccccatggacgaacactcctgcccgctgattttctccagctatggctatcccaaagaagaaatgatttatagatggagaaaaaattcagtggaggcagctgaccagaaatcatggcggctttatcagtttgacttcatgggcctcagaaacaccacagaaatcgtgacaacgtctgcaggtaggaatttactgaaagaggcacagctctcaaaagccagagaggcctaaggccatatgtagtcatatccttaatgtacaagccttttgggcaaccatgatacataagtgatatttgagacaaaacaagtgattcaaagtgaaactatgttttcatgttttaattggtatgggagagggatgttagaaataattcatatttttgaatccaggctgtgtttgcataatgtctataaacctagctataaacttaacctaactcattactgaccatatttacataaaccaattttgctgatggggagagttctgcaaatttccacgtacataagaagaatcaaatattattgagaatccacacataaaagaagctggtgtgatatgtcctttgagtttcaattgcttttatttactctaagttttatctttaactttgagtttctttttcaatgattgaaagtaattacctaccaatttgattttatgaagtgatcattatatgcatattcaaaatcctgtaattaaataaaaagagttgttctgcctatgaa

SEQ ID NO: 8081 - DNA, 615 bp, Homo sapiens
  ENST00000553440
gggcaaagagggccggcggagaccaggtccgcgccggaggaagccgcgcccggccgaggccccggaccctgcgccccgagctccacggcaccatggccccgaagctgctgctcctcctctgcctgttctcgggcttgcacgcgcggtccagaaaggtggaagaggatgaatatgaagattcatcatcaaaccaaaagtgggtcttggctccaaaatcccaagacaccgacgtgactcttattctcaacaagttgctaagagaatatgataaaaagctgaggccagatattggaataaaaccgaccgtaattgacgttgacatttatgttaacagcattggtcctgtgtcatcaataaacatggtaagaagctcctttattttctgatctaacggctgttgcacctcttcttgttacattctcattgtggatttctgtttgagatttatcatgccggtttaaaactcacactgacttcttaaatctgtaacacttattggaatattgaaaatggtaaaaaaaaaaatgaagaaagatagcttgtgatggtagtagcatttccacttttagtttcttctttcaacatccaagagacctgtcttttatagtgtttctt

SEQ ID NO: 8082 - DNA, 446 bp, Homo sapiens
  ENST00000554786
agaagctggggtgaggggtacagaagaggatggctgctgggtatgcaacctagagtcagtcagtcagtcacaaacatggcaggaaaataagctgtctgcctcctacaccctgatctggatgtttgtaagaagaaaaggtgcaacagaatttattccggaatggagaagacacaccctcagcgcgccctcgtcagaacccagaatggtcagaatagctggccaaagaggaaggagacctggccaggtgcaattctcgaaggacaaatgaagcactggtcagattccggggcatcagttcacccaatcttgagaaaattctgggggaaaagagttccattcatggtgaatgaaagaagaagctttctagaactaatctgaaagcaaagtgtccctaaagagaaacccatcaaaagtcactgctggattttcacccaaagtgaggcaga

SEQ ID NO: 8083 - DNA, 774 bp, Homo sapiens
  ENST00000554696
gaagctggggtgaggggtacagaagaggatggctgctgggtatgcaacctagagtcagtcagtcagtcacaaacatggcaggaaaataagctgtctgaataccaaattgacatattttttgctcagacctggacagatagtcgccttcgattcaacagcacaatgaaaattcttactctgaacagcaacatggtggggttaatctggatcccagacaccatcttccgcaattctaaaaccgcagaggctcactggatcaccacacccaatcagctcctccggatttggaatgacgggaaaatcctttacactttgaggctcaccatcaatgctgagtgccagctgcagctgcacaacttccccatggacgaacactcctgcccgctgattttctccagctatggctatcccaaagaagaaatgatttatagatggagaaaaaattcagtggaggcagctgaccagaaatcatggcggctttatcagtttgacttcatgggcctcagaaacaccacagaaatcgtgacaacgtctgcaggtgattatgttgtcatgactatatattttgaattgagtagaagaatgggatacttcaccattcagacatacattccctgtatactgactgtggttttatcctgggtgtcattttggatcaaaaaagatgctacgccagcaagaacagcattaggcatcaccacggtgctgaccatgaccaccctgagcaccatcgccaggaagtccttgccacgcgtgtcctacgtgaccgccatg

SEQ ID NO: 8084 - DNA, 342 bp, Homo sapiens
  ENST00000557596
atgctgagtgccagctgcagctgcacaacttccccatggacgaacactcctgcccgctgattttctccagctccaccatcttggccttcagattgtctcttcatgcatatcgctgacgtttaaaagtttcaagcttgatggtgtcttacagatcacctcctcggagactcgcttccattcgtggggaaatgaaggctcagagaggttgcatttgcctccatggggcccacagagctggctggtggttgctgtgaattgggaaatcacattttctgacttctcatcgcgtgttctcactactcaacactgggaggaaccattgaattaaaagttcaaaatcaa

SEQ ID NO: 8085 - DNA, 717 bp, Homo sapiens
  ENST00000451330
gtgattatgttgtcatgactatatattttgaattgagtagaagaatgggatacttcaccattcagacatacattccctgtatactgactgtggttttatcctgggtgtcattttggatcaaaaaagatgctacgccagcaagaacagcattaggcatcaccacggtgctgaccatgaccaccctgagcaccatcgccaggaagtccttgccacgcgtgtcctacgtgaccgccatggacctttttgtgaccgtgtgcttcctgtttgtcttcgccgcgctgatggagtatgccaccctcaactactattccagctgtagaaaaccaaccaccacgaagaagacaacatcgttactacatccagattcctcaagatggattcctgagcgaataagcctacaagccccttccaagccatcctgctgccctgcctgtggcctccaagggttgccctttagatctctggtgagccatccccgcatcagcagagccttctgcctccccgtctaagtcagaatcttcctgtgtggctgccttaccttgcaaatggccagacttctcctctgtgtctccggtagctcccagttccatccacatagcaagggactacacagaggcatgaagcaacgagtggatgaatgtctggctgatcactgtcaaagcacacgtgtaggaaacctttattgcaattgtttgttaataaaggcagatctttcaa

SEQ ID NO: 8086 - DNA, 1235 bp, Homo sapiens
  ENST00000333743
ggaataccaaattgacatattttttgctcagacctggacagatagtcgccttcgattcaacagcacaatgaaaattcttactctgaacagcaacatggtggggttaatctggatcccagacaccatcttccgcaattctaaaaccgcagaggctcactggatcaccacacccaatcagctcctccggatttggaatgacgggaaaatcctttacactttgaggctcaccatcaatgctgagtgccagctgcagctgcacaacttccccatggacgaacactcctgcccgctgattttctccagctatggctatcccaaagaagaaatgatttatagatggagaaaaaattcagtggaggcagctgaccagaaatcatggcggctttatcagtttgacttcatgggcctcagaaacaccacagaaatcgtgacaacgtctgcaggtgattatgttgtcatgactatatattttgaattgagtagaagaatgggatacttcaccattcagacatacattccctgtatactgactgtggttttatcctgggtgtcattttggatcaaaaaagatgctacgccagcaagaacagcattaggcatcaccacggtgctgaccatgaccaccctgagcaccatcgccaggaagtccttgccacgcgtgtcctacgtgaccgccatggacctttttgtgaccgtgtgcttcctgtttgtcttcgccgcgctgatggagtatgccaccctcaactactattccagctgtagaaaaccaaccaccacgaagaagacaacatcgttactacatccagattcctcaagatggattcctgagcgaataagcctacaagccccttccaactattccctcctggacatgaggccaccaccaactgcgatgatcactttaaacaattccgtttactggcaggaatttgaagatacctgtgtctatgagtgtctggatggcaaagactgtcagagcttcttctgctgctatgaagaatgtaaatcaggatcctggaggaaagggcgtattcacatagacatcttggagctggactcgtactcccgggtctttttccccacgtccttcctgctctttaacctggtctactgggttggatacctgtatctctaagtgttgctcagagtgaagagtgaagagcatttggtacacacttgaccttctgtcgtccccagaccagtagtgaccaatcgggagtagcaaggaaggacac

SEQ ID NO: 8087 - DNA, 818 bp, Homo sapiens
  ENST00000579368
acaataaataaaacagttggtgtcaatacaactccccttattttctctcaagtcacctggatcgtcctgaccccgggaaccccgtctgcagcaccaggccccctccgtggagaaaagatggagccggattaagcacccagtgctaaggcgactaagacgccactgcccgcaggccctgccggaaaatactcagagagtgcagcaggcgccgcgattccttagaaagtgctggcgtggcctctcctgacacagaaagccggctcctggatgcttacaaaggactggcccgcgcaacaccgttgctcctcaacccgggccacactccaaggacctctactgagcttcagcttgctcaccgaaaacggcgcggccccctctacccgggatgtcggagcccaggagaccctgagagcccccagctctttccgtaattgcaggagaaggggcaagcgggtccgtagccgggggccctccagtggcattatcctgaaccgccacgcccgcacgtggcccggctagagctccctggcgaaggatcacctgttcctacagtgacaactggacctggcccgaacccctggcatctggcaacattattacctgtcgaaacagaagtagagatttgaaatagaggatgcctgttcccatttcctcctgctgtctggaaggaagtctggctttccagcccaactctaagctcatctttacatacaaaataagggtatgtttacatggaaagcaaaaatagaaccatggatttacagaaggttccatagcagcaaataacagtgcttatgaaataaacattttaaatatta

SEQ ID NO: 8088 - DNA, 5858 bp, Homo sapiens
  ENST00000376261
gcggccgcccgcacttcccgcctctggctcgcccgaggacgcgctggcacgcctcccaccccctcactctgactccagctggcgtgcatggtctgcctcgcatcctcacgactcagctccctccctctctcgtgtttttttcctccgccgccccctcattcatccccactgggctccctttccctcaaatgctctggggctctccgcgctttcctgagtccgggctccgaggacccttaggtagtcccggtctcttttaaagctccccggcttccaaagggttgccacgtccctaaaccctgtctccagctcgcatacacacacgcacagacacgcacgttttctgttcctgcgtgacacccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacagcgcgagcctggtgccaagtggctcagaagttcacgggcggcatcggaaacaaactgtgcgccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacagggcatcctagatacttcaatcaactttctactggtttggatatggttggattagcagcagactggctgacatcaacagcaaatactaacatgttcacctatgaaattgctccagtatttgtgcttttggaatatgtcacactaaagaaaatgagagaaatcattggctggccagggggctctggcgatgggatattttctcccggtggcgccatatctaacatgtatgccatgatgatcgcacgctttaagatgttcccagaagtcaaggagaaaggaatggctgctcttcccaggctcattgccttcacgtctgaacatagtcatttttctctcaagaagggagctgcagccttagggattggaacagacagcgtgattctgattaaatgtgatgagagagggaaaatgattccatctgatcttgaaagaaggattcttgaagccaaacagaaagggtttgttcctttcctcgtgagtgccacagctggaaccaccgtgtacggagcatttgaccccctcttagctgtcgctgacatttgcaaaaagtataagatctggatgcatgtggatgcagcttggggtgggggattactgatgtcccgaaaacacaagtggaaactgagtggcgtggagagggccaactctgtgacgtggaatccacacaagatgatgggagtccctttgcagtgctctgctctcctggttagagaagagggattgatgcagaattgcaaccaaatgcatgcctcctacctctttcagcaagataaacattatgacctgtcctatgacactggagacaaggccttacagtgcggacgccacgttgatgtttttaaactatggctgatgtggagggcaaaggggactaccgggtttgaagcgcatgttgataaatgtttggagttggcagagtatttatacaacatcataaaaaaccgagaaggatatgagatggtgtttgatgggaagcctcagcacacaaatgtctgcttctggtacattcctccaagcttgcgtactctggaagacaatgaagagagaatgagtcgcctctcgaaggtggctccagtgattaaagccagaatgatggagtatggaaccacaatggtcagctaccaacccttgggagacaaggtcaatttcttccgcatggtcatctcaaacccagcggcaactcaccaagacattgacttcctgattgaagaaatagaacgccttggacaagatttataataaccttgctcaccaagctgttccacttctctaggtagacaattaagttgtcacaaactgtgtgaatgtatttgtagtttgttccaaagtaaatctatttctatattgtggtgtcaaagtagagtttaaaaattaaacaaaaaagacattgctccttttaaaagtcctttcttaagtttagaatacctctctaagaattcgtgacaaaaggctatgttctaatcaataaggaaaagcttaaaattgttataaatacttcccttacttttaatatagtgtgcaaagcaaactttattttcacttcagactagtaggactgaatagtgccaaattgcccctgaatcataaaaggttctttggggtgcagtaaaaaggacaaagtaaatataaaatatatgttgacaataaaaactcttgcctttttcatagtattagaaaaaaatttctaatttacctatagcaacatttcaaatgtatttaaatacatataattttacaaaaggaaaatatatatattaaaaaagatatcctattttgtaacatatagatttttattttatataggttatacaaactgcgggggcagatataaaatctaagccagatttttttttcctttctcttaatggaggcacaataaaacacttagcaaagttattttgaaacattgacccacgaaattcttaaaaggtattattgcttctttctatacatgttatggcttatcacatctctaaagttagtatttcaagacaaacacaaaagaatactgcgagttctttaaaataattgatcccattggcagtaagattctcttcccctttaagttttccacccattttactcttagcggactcactctgcaagcgtgacaaaccaggcttcatctcagattaaattagggtaattgtctctattctgctttccagttcggcctgttttgaacagaaggttgatgctagttcttgaggcatcttccaaatagtattcttttattaggtcatttgaattaattagagaaagtaaaaataaaaccttatcagcctgagcaaagaggaatgaagcacactcccagaatgtggtgagcccagaaaattaaagttggccttgggagaagagatctctgtgggacaataatgacatcatcctggcgccatattgccactgtccaggaaagagaaatttacctccaggccagttgcgcatttccatcccctccccattcctccccacaaagtctctcccactagactccctaccactgggacccaaaatagttactttatattccatgggtggttgtttttcttccatgaaatgagcctctcaccctagattttgaggcattatcttaagattttcctttatccatctcccatcgagatccaaagtgaccagaatatgcagaaataataagatccttagaattcaaaatagtatttttaaaacatccttctttccctgtgaacctgatagaaaaacatgagctaacaaaagcttccatagatatttatggggtcacacatcgtcagattccaagtgctgattggagaacaatagattgatatgcagactgcaaatgcaaatttaggaacattctccatttctgaatggaccaggtagttcagtactcagactgcaggtatacaagggaagagagaaggccctgcccttcaacgggtagaaatgccctacaatataacatagagaaatgccctataatataaccacaggatccagccatctgaaattttcataagcttccccctacattatttctcctaggctatatgcaaaaacagtgataacttgatatgaacatggctttgggccctttctgtctagaaaaacaaatgggttcactatgacaatcagaaataaactctttcatctgtcccgcagaatttcatgaaggagtaaccttccattctaggctttgtctaatggccaagcattagacaaagcattagaaagcagttcctttctcaaaactgcctgctgagaataagcacatagctgcccgactatccggagcctcaggcccaaaggttccacttcagagacagagatgctaattgatccaacctgctgtccttcgtggagaagacagtggggcccagtgccctggtgaaccaaccctgctgtactccaggatgctttatcttttgagttacagatcctagattataaactgctgctttttaggttaatgagatggtaaaattttaaaggacaatttgtgcctatatatgaaattccagcaaaacaattctagcaacaacaatagctcttcttccccgctcccctaccccttcccagtactccttcaaattggctgagagccttgctcaggcctgtgcagggaaatccttaccaactgtagcccaaagaaggaagcaaataaaagcctagtaggtcccagtagtttaataaatcatcttgaaaggagatgtggaatcaggtcagaagagagtaagggaggaagggagggagggagggagggagggaaggagggagggaggaaggaaatgaagggagggagggagggaggaaagaagggagattatttttaatattagcccaaattcccagtgccatggtctttatgtgtgcccattctttacaaatcttagaaaagtttggttttagctttaatcagaactgacatggccattttcatttatacagcaatattgtgtttatcatttaaaatacttgaacaaacaagtgtgatatgtctttatctgagacctatacatggtatggacttcatatactgccacaggatgtgaggaaagaaaaggaaatcaattctgactgtgttgcctttattatctggataatactgtcttgtcacctcagattggggttgtgcactttagatctgaactgtacagtgttgcaaatcaacatgtgtttctgtaaaagcttgtacaatatattattgatatgtctttttctgtgtggtagctgtattgaactttgatattatgaaaactacatttgcatctgttcctgttctctctctctctctctttcctaactatatgccctccacatcggctctaatagagaacatgccctcagctaagccccctactgagaaacttcctttgagaattgtgcgacttcacaaaatgcaaggtgaacaccactttgtctctgagaacagacgttaccaattatggagtgtcaccagctgccaaaatcgtaggtgttggctctgctggtcactggagtagttgctactcttcagaatatggacaaagaaggcacaggtgtaaatatagtagcaggatgaggaacctcaaactgggtatcattttgcacgtgctcttctgttctcaaatgctaaatgcaaacactgtgtatttattagttaggtgtgccaaactaccgttcccaaattggtgtttctgaatgacatcaacattcccccaacattactccattactaaagacagaaaaaaataaaaacataaaatatacaaacatgtggcaacctgttcttcctaccaaatataaacttgtgtatgatccaagtattttatctgtgttgtctctctaaacccaaataaatgtgtaaatgtggacaca

SEQ ID NO: 8089 - DNA, 2462 bp, Homo sapiens
  ENST00000259271
acccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacagcgcgagcctggtgccaagtggctcagaagttcacgggcggcatcggaaacaaactgtgcgccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacagggcatcctagatacttcaatcaactttctactggtttggatatggttggattagcagcagactggctgacatcaacagcaaatactaacatgttcacctatgaaattgctccagtatttgtgcttttggaatatgtcacactaaagaaaatgagagaaatcattggctggccagggggctctggcgatgggatattttctcccggtggcgccatatctaacatgtatgccatgatgatcgcacgctttaagatgttcccagaagtcaaggagaaaggaatggctgctcttcccaggctcattgccttcacgtctgaacatagtcatttttctctcaagaagggagctgcagccttagggattggaacagacagcgtgattctgattaaatgtgatgagagagggaaaatgattccatctgatcttgaaagaaggattcttgaagccaaacagaaagggtttgttcctttcctcgtgagtgccacagctggaaccaccgtgtacggagcatttgaccccctcttagctgtcgctgacatttgcaaaaagtataagatctggatgcatgtggatgcagcttggggtgggggattactgatgtcccgaaaacacaagtggaaactgagtggcgtggagagggccaactctgtgacgtggaatccacacaagatgatgggagtccctttgcagtgctctgctctcctggttagagaagagggattgatgcagaattgcaaccaaatgcatgcctcctacctctttcagcaagataaacattatgacctgtcctatgacactggagacaaggccttacagtgcggacgccacgttgatgtttttaaactatggctgatgtggagggcaaaggggactaccgggtttgaagcgcatgttgataaatgtttggagttggcagagtatttatacaacatcataaaaaaccgagaaggatatgagatggtgtttgatgggaagcctcagcacacaaatgtctgcttctggtacattcctccaagcttgcgtactctggaagacaatgaagagagaatgagtcgcctctcgaaggtggctccagtgattaaagccagaatgatggagtatggaaccacaatggtcagctaccaacccttgggagacaaggtcaatttcttccgcatggtcatctcaaacccagcggcaactcaccaagacattgacttcctgattgaagaaatagaacgccttggacaagatttataataaccttgctcaccaagctgttccacttctctagagaacatgccctcagctaagccccctactgagaaacttcctttgagaattgtgcgacttcacaaaatgcaaggtgaacaccactttgtctctgagaacagacgttaccaattatggagtgtcaccagctgccaaaatcgtaggtgttggctctgctggtcactggagtagttgctactcttcagaatatggacaaagaaggcacaggtgtaaatatagtagcaggatgaggaacctcaaactgggtatcattttgcacgtgctcttctgttctcaaatgctaaatgcaaacactgtgtatttattagttaggtgtgccaaactaccgttcccaaattggtgtttctgaatgacatcaacattcccccaacattactccattactaaagacagaaaaaaataaaaacataaaatatacaaacatgtggcaacctgttcttcctaccaaatataaacttgtgtatgatccaagtattttatctgtgttgtctctctaaacccaaataaatgtgtaaatgtggacaca

SEQ ID NO: 8090 - DNA, 641 bp, Homo sapiens
  ENST00000428517
gcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacagcgcgagcctggtgccaagtggctcagaagttcacgggcggcatcggaaacaaactgtgcgccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacaggtattgtctcatcgaaaataataaagctcttttttcgtttacaa

SEQ ID NO: 8091 - DNA, 680 bp, Homo sapiens
  ENST00000376248
tccaagagggctctgaggccgtggcgctcttcccccagcgcggcccttgggatggcgggtggccgacgatccaggcgctcgtgcgctcactgaatcgatgacggctggcttccctaggccgctggggcctcggacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacagggcatcctagatacttcaatcaactttctactggtttggatatggttggattagcagcagactggctgacatcaacagcaaatactaacatgttcacctatgaaattgctccagtatttgtgcttttggaatatgtcacactaaagaaaatgagagaaatcattggctggccagggggctctggcgatgggatattttctcccggtacatgatatttcaactttctttgtgttttttcttctaatatgcaatgccttgttgtaaacctagggaagattaaaaatctagcctatgcctctgcttaggttaaata

SEQ ID NO: 8092 - DNA, 1496 bp, Homo sapiens
  ENST00000370986
ctgactccaggagctggggtcaaattgctggagcaggctgatttgcatagcccaatggccaagctgcatgcaaatgaggcggaaggtggttggctgagggttggcaggataaccccggagagcggggccctttgtcctccagtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaaggatggataaggtgggggatgccctggaggaagtgctcagcaaagccctgagtcagcgcacgatcactgtcggggtgtacgaagcggccaagctgctcaacgtcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaagtgtgcagccatagtttgggtatttttggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattgcatcatttc

SEQ ID NO: 8093 - DNA, 803 bp, Homo sapiens
  ENST00000370985
agtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaagcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgc

SEQ ID NO: 8094 - DNA, 874 bp, Homo sapiens
  ENST00000460575
agcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaaggatggataaggtgggggatgccctggaggaagtgctcagcaaagccctgagtcagcgcacgatcactgtcggggtgtacgaagcggccaagctgctcaacgtgtaagtggggcccttgcgcgtcccccatggcaccccttcccgccccagcccgggaggtcgccttggctgggcgcccctcgcccggccgcgccacttcctgtcgcttttctgcctgtctcggaagggagggggcgagcgggccgggcggcgacccccagggacccgggcagtggttgagggcgcccgcgcttctgcgctcactggccccgcccgctgcccccagcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgg

SEQ ID NO: 8095 - DNA, 688 bp, Homo sapiens
  ENST00000484245
gggactctccgtggagctcccacggactgaaagagcgtgccccccaacccgaacgagccccgccggggcctttgcaaagggcagcagtggccgtcgctgcccgtgcggctcccgtggctggcagcctgtggcaggggcactctcgggacttctcacgggacgcccggtccttgggcgtgcaggggtcatggggggtgacggggccgcgggagcgccgggttttcgtagagcccaggtgcgcggtggtgcttgcattcgagagggaggggcgtggtaccggacgaggggggcggcgatggccccgagggcaccggggctgacgggacccctcgcccttgcccgcgtgtaggatggataaggtgggggatgccctggaggaagtgctcagcaaagccctgagtcagcgcacgatcactgtcggggtgtacgaagcggccaagctgctcaacgtcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgac

SEQ ID NO: 8096 - DNA, 1142 bp, Homo sapiens
  ENST00000617962
ggagagcggggccctttgtcctccagtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaaggatggataaggtgggggatgccctggaggaagtgctcagcaaagccctgagtcagcgcacgatcactgtcggggtgtacgaagcggccaagctgctcaacgtaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaagtgtgcagccatagtttgggtatttttggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattgcatcatttc

SEQ ID NO: 8097 - DNA, 1635 bp, Homo sapiens
  ENST00000406955
actattgcagcctccctgattccagaaggtaccttggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaa

SEQ ID NO: 8098 - DNA, 1908 bp, Homo sapiens
  ENST00000402321
gaatctttctgtgcccttggatgaaagagctgcttgcttgttggggtccaaagagaggtgaggactggccagagctgtccagtggaggcagaaggcctgggcaacacctgcagggtactggggtgtgccacctgctatccccaggaagcaaactcatgaatattcacaccactggagtgggagggagccagccagcttgctgctgggtgtcattggagcattcctgtctcccagtgatcgcagaggcagcctgggagttggacgtggctcaggcagtgggtagaaaggggcagccagccacagcccgaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaa

SEQ ID NO: 8099 - DNA, 1712 bp, Homo sapiens
  ENST00000402369
aggcctggtggagcggggggcccggccgggtgcgccccgccgcccagtgagcgcccgggcggcgcggcccgggccgagccagccacgctgaggcggaggaggacggggacaaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaa

SEQ ID NO: 8100 - DNA, 1791 bp, Homo sapiens
  ENST00000401975
ggcagcctgggagttggacgtggctcaggcagtgggtagaaaggggcagccagccacagcccgagggtctcactgtgtcatccagagctggagtgcagcggcacagtcatggctcactggaactcaggctcaagcaatcctcccgcctcagccttccaagtaactaggactacaggcatgtgccaccacgcctggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgtt

SEQ ID NO: 8101 - DNA, 1819 bp, Homo sapiens
  ENST00000406361
gcatggaccaggcctggtggagcggggggcccggccgggtgcgccccgccgcccagtgagcgcccgggcggcgcggcccgggccgagccagccacgctgaggcggaggaggacggggacaagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttg

SEQ ID NO: 8102 - DNA, 894 bp, Homo sapiens
  ENST00000441967
cctagagagaaggcgactctggtctgccttgtggcagtttaagctctggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaac

SEQ ID NO: 8103 - DNA, 851 bp, Homo sapiens
  ENST00000431313
cccgggccgagccagccacgctgaggcggaggaggacggggacaaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccaccaggaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacc

SEQ ID NO: 8104 - DNA, 882 bp, Homo sapiens
  ENST00000452827
actattgcagcctccctgattccagaaggtaccttgggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtgg

SEQ ID NO: 8105 - DNA, 755 bp, Homo sapiens
  ENST00000437282
gattccagaaggtaccttgggtctcactgtgtcatccagagctggagtgcagcggcacagtcatggctcactggaactcaggctcaagcaatcctcccgcctcagccttccaagtaactaggactacaggcatgtgccaccacgcctggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacc

SEQ ID NO: 8106 - DNA, 582 bp, Homo sapiens
  ENST00000416358
acaaatggaattctgggcccggctgcaggctcctgaagggctccttgcttcactttgactgggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcg

SEQ ID NO: 8107 - DNA, 533 bp, Homo sapiens
  ENST00000427899
attgcagcctccctgattccagaaggtaccttggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccaccaggaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgct

SEQ ID NO: 8108 - DNA, 656 bp, Homo sapiens
  ENST00000423299
attcctgtctcccagtgatcgcagaggcagcctgggagttggacgtggctcaggcagtgggtagaaaggggcagccagccacagcccgagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtg

SEQ ID NO: 8109 - DNA, 584 bp, Homo sapiens
  ENST00000443136
gaagggctccttgcttcactttgactgggtgaggaatatggatgagcccttttaggggctccacacgactccaaacagggcagagcaggatggaacacaggtgcccatgggggtcatcaggctggggactgctggaatctccaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgctt

SEQ ID NO: 8110 - DNA, 639 bp, Homo sapiens
  ENST00000423371
atgcacaaatggaattctgggcccggctgcaggctcctgaagggctccttgcttcactttgactgggtgaggaatatggatgagcccttttaggggctccacacgactccaaacagggcagagcaggatggaacacaggtgcccatgggggtcatcaggctggggactgctggaatctccagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccaccaggaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccg

SEQ ID NO: 8111 - DNA, 553 bp, Homo sapiens
  ENST00000428682
agtgatcgcagaggcagcctgggagttggacgtggctcaggcagtgggtagaaaggggcagccagccacagcccgaggatgctaaataaacctgcgctttgactgagacctgtcacgtgaggtcagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccg

SEQ ID NO: 8112 - DNA, 639 bp, Homo sapiens
  ENST00000453479
tcagccagcttaaaaattaaaaggagtggaaagtttggggccctggttctctacccggttcattttaatttttaaattttaaccttctccctgccccattccccaacctctctttgagttgcttcacccaccgtctctgcaaccctggggctgtctctttccaggtggttgtcagtctatctctccagtgcctctctgtccctgtctggaccctgctggggggccacagagcaggcaaaggcagggctcaactgccaggcctgggcagccttgggggctccctggggccagcttcctgacacttgccctactctgtgctgcccctgcaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccaga

SEQ ID NO: 8113 - DNA, 563 bp, Homo sapiens
  ENST00000426220
tcctgaagggctccttgcttcactttgactgggtgaggaatatggatgagcccttttaggggctccacacgactccaaacagggcagagcaggatggaacacaggtgcccatgggggtcatcaggctggggactgctggaatctccagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcgg

SEQ ID NO: 8114 - DNA, 567 bp, Homo sapiens
  ENST00000447224
gattccagaaggtaccttgaaaagttctccagagaatggctaggggcgcctccagctttctcattttacagatgaaaaactgagactccatgagggttcttggcttgtctgaaatcacagtgctggattgaaacacaggcttgagggtcccagagcctgagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgtt

SEQ ID NO: 8115 - DNA, 572 bp, Homo sapiens
  ENST00000411821
gatgcacaaatggaattctgggcccggctgcaggctcctgaagggctccttgcttcactttgactgggtgaggaatatggatgagcccttttaggggctccacacgactccaaacagggcagagcaggatggaacacaggtgcccatgggggtcatcaggctggggactgctggaatctccagccttagagcctgttctgggctctctgcaggcgtctgcggttgctgtgtccttggcccaaggatacctggaatctttctgtgcccttggatgaaagagctgcttgcttgttggggtccaaagagaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaag

SEQ ID NO: 8116 - DNA, 567 bp, Homo sapiens
  ENST00000445645
ggaattctgggcccggctgcaggctcctgaagggctccttgcttcactttgactgggtgaggaatatggatgagcccttttaggggctccacacgactccaaacagggcagagcaggatggaacacaggtgcccatgggggtcatcaggctggggactgctggaatctccaggatgctaaataaacctgcgctttgactgagacctgtcacgtgaggtcagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcg

SEQ ID NO: 8117 - DNA, 575 bp, Homo sapiens
  ENST00000448604
gatgcacaaatggaattctgggcccggctgcaggctcctgaagggctccttgcttcactttgactggccttagagcctgttctgggctctctgcaggcgtctgcggttgctgtgtccttggcccaaggatacctggaatctttctgtgcccttggatgaaagagctgcttgcttgttggggtccaaagagaggatgctaaataaacctgcgctttgactgagacctgtcacgtgaggtcagggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtg

SEQ ID NO: 8118 - DNA, 1782 bp, Homo sapiens
  ENST00000338911
ctggggctgtctctttccaggtggttgtcagtctatctctccagtgcctctctgtccctgtctggaccctgctggggggccacagagcaggcaaaggcagggctcaactgccaggcctgggcagccttgggggctccctggggccagcttcctgacacttgccctactctgtgctgcccctgcaggtgtctgagatgctgccaccgcagaagaagccctgggagtccatggctaaggggctggtgctgggcgcgctcttcactagtttcctgctgctggtgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgtt

SEQ ID NO: 8119 - DNA, 548 bp, Homo sapiens
  ENST00000460995
aagctcgggcttcagaaggaactctgcaacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctctt

SEQ ID NO: 8120 - DNA, 735 bp, Homo sapiens
  ENST00000482469
gtctctctgtccctctgtctctctctctctgtttctctgtgtgtgtgtgtgtgtgtgtgtgtgtctctctctctttctgtctccctctccagccccaccctttcagtctcctccgggtgcactgataaggttggaaagtggaatggtggacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcct

SEQ ID NO: 8121 - DNA, 579 bp, Homo sapiens
  ENST00000498000
gattaggaagctcgggcttcagaaggaactctgcaacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttccccca

SEQ ID NO: 8122 - DNA, 1404 bp, Homo sapiens
  ENST00000411994
gtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgt

SEQ ID NO: 8123 - DNA, 1695 bp, Homo sapiens
  ENST00000423751
gtcgggcggtggctgggatgggcgggagggcccggcccgatttcccttgctgctccccttgtggcctgacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccaccctccactcattttgttctttccccccaactttttttttttttgaaacggagtcttgctctgtcccccaggctggagtgcagtggcatgatctcggctcactgcaacctctgcctcc

SEQ ID NO: 8124 - DNA, 2537 bp, Homo sapiens
  ENST00000360039
gaggggaagatgcagcgagggagagacctagaaccgcgatcaaagctgcagcagctgctggggctggcggcacaaagggaggagggaggagcctgggcgctgagaaagttcttggggaaagttgagctgagccaagagtcgggcggtggctgggatgggcgggagggcccggcccgatttcccttgctgctccccttgtggcctgacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccaccctccactcattttgttctttccccccaactttttttttttttgaaacggagtcttgctctgtcccccaggctggagtgcagtggcatgatctcggctcactgcaacctctgcctcccaggttcaagcgattctcctgcctcagcctccagagtagctaggattacagatacgtgccaccatacccggctaatttttatatttttagagacagggattcaacatgttggttaggctggtcttgaactcctcacctcaggtgatccacatgactctgcctcccaaagtgctgccattacaggcgtgagccactaggcctgacctccccttcccctttcctgccccaaggcagatccacatcaccgaagctccctagaggggcaaaagatggagtgagccacaggaagtttggggcgtggtgagttggaatgatacgtccatttctctatgaaatatttgctactagactgttcatttctctctgacatgtttgttgaatgaataaataatttgaaactt

SEQ ID NO: 8125 - DNA, 3162 bp, Homo sapiens
  ENST00000495882
ctgcagttagtgtttgcgcctttctccttatctttgtgtcatagtctctctgtccctctgtctctctctctctgtttctctgtgtgtgtgtgtgtgtgtgtgtgtgtctctctctctttctgtctccctctccagccccaccctttcagtctcctccgggtgcactgataaggttggaaagtggaatggtgggtaagtccagggatctgggctttataagtagccacacgtctcccccagcccctgtcatacatgggggtctgccccgtgctgagacagagaaaaaagaggcgcgggaatttataacccaatggctcttacccattgcaatgccactcctggaagtccaacctcccttcctcctgcctgggttcatacacctgtgtcctgtctgatcctcattcccactgtatggcttcccttcctggtcctgggatagggctctttatccccatctgtgacagccagaggggctctggaggaaaccaggttcccgaccatggtctgacctgactgtgttaatgagctgattgatctgatctctctctctcttgctggctgtttcattcacgagctggggctttttctctccttcccttataaatccccaaggctcagggacaactgtaggtggggagcgggaggaactggagataagaaagtgatagagcagagacagtagttgtggggccacctaggagagtctgggtatagacaacatccccagccactccccttccctgaaggaggtctcagctgcagcaggagagaaggctgcctctgcctctctccttagacttcccttcttcccccctcatttcccttctagacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccaccctccactcattttgttctttccccccaactttttttttttttgaaacggagtcttgctctgtcccccaggctggagtgcagtggcatgatctcggctcactgcaacctctgcctcccaggttcaagcgattctcctgcctcagcctccagagtagctaggattacagatacgtgccaccatacccggctaatttttatatttttagagacagggattcaacatgttggttaggctggtcttgaactcctcacctcaggtgatccacatgactctgcctcccaaagtgctgccattacaggcgtgagccactaggcctgacctccccttcccctttcctgccccaaggcagatccacatcaccgaagctccctagaggggcaaaagatggagtgagccacaggaagtttggggcgtggtgagttggaatgatacgtccatttctctatgaaatatttgctactagactgttcatttctctctgacatgtttgttgaatgaataaataatttgaaacttc

SEQ ID NO: 8126 - DNA, 2334 bp, Homo sapiens
  ENST00000413800
gacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccaccctccactcattttgttctttccccccaactttttttttttttgaaacggagtcttgctctgtcccccaggctggagtgcagtggcatgatctcggctcactgcaacctctgcctcccaggttcaagcgattctcctgcctcagcctccagagtagctaggattacagatacgtgccaccatacccggctaatttttatatttttagagacagggattcaacatgttggttaggctggtcttgaactcctcacctcaggtgatccacatgactctgcctcccaaagtgctgccattacaggcgtgagccactaggcctgacctccccttcccctttcctgccccaaggcagatccacatcaccgaagctccctagaggggcaaaagatggagtgagccacaggaagtttggggcgtggtgagttggaatgatacgtccatttctctatgaaatatttgctactagactgttcatttctctctgacatgtttgttgaatgaataaataatttgaaacttc

SEQ ID NO: 8127 - DNA, 2169 bp, Homo sapiens
  ENST00000324589
ctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaaggtttggtccttgtttttcaaggtggctgggatgagcccttgggcgcctcaggtgcctgtatcacccactcctccctaccaaagagggcatcttcctacaggaggacaccttgctgtatgtcatttcccatgtctcttgcaagaagctcagttccatttgcagactcaggtctttcttcaagtcagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgga

SEQ ID NO: 8128 - DNA, 2733 bp, Homo sapiens
  ENST00000349752
ggcatcccgagtgcaccgctcccgccccgccccgccttgccccaacccacgatggtctgggagctgcgcccagggcttggcgctggcggccccgcaacagcaccgagcgtttcggtcggcgggcggcggtagcgccccctctcagagccccgctcactcccacctgggctcgctccgagtcggcctgtctgtcgggcccgccctccccgctcactccctccgccctcgtgctcctcccggggtgcttggcacagcctcggattcctccctctcgctgctcgagtcagtttccctatcggcggcagcgggcaaggcggcggcggcggcggcggcagccgcggtggcggcgtggggaacatctcggcagccaccgcgcttctcccgctggagcgggcgtccagcttggctgccctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgga

SEQ ID NO: 8129 - DNA, 2496 bp, Homo sapiens
  ENST00000406653
actgaaaaattagctggtgcctgtatttcaggcttattgtttcctaggatctcagggagatcaggccacgtggtctgtggattaattaaggcacccagataattggctattaatagatggccaattgatggctgccagctgggtgctgaattgactaatgtccttatggtgggcaggtggtctttatcagaagaggagctagctgaaagactttactaattaaagggtgaatcaggaaaagaagataagaggtagcttttttccccaccacttggtgtgatgttttacagtttacaaagcatttatatccacagttgcctcatttgatccttactgcgactttgtgaggtttggtccttgtttttcaaggtggctgggatgagcccttgggcgcctcaggtgcctgtatcacccactcctccctaccaaagagggcatcttcctacaggaggacaccttgctgtatgtcatttcccatgtctcttgcaagaagctcagttccatttgcagactcaggtctttcttcaagtcagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgg

SEQ ID NO: 8130 - DNA, 844 bp, Homo sapiens
  ENST00000475320
tgttgagagcagattggacctgaggaagaatctgcgctgccagagcttcaagtggtacctggagaatatctaccctgaactcagtggactctcctctctccctgtgactctcctccagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttc

SEQ ID NO: 8131 - DNA, 1045 bp, Homo sapiens
  ENST00000486564
tttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaagtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcc

SEQ ID NO: 8132 - DNA, 1619 bp, Homo sapiens
  ENST00000430167
cctcgtgctcctcccggggtgcttggcacagcctcggattcctccctctcgctgctcgagtcagtttccctatcggcggcagcgggcaaggcggcggcggcggcggcggcagccgcggtggcggcgtggggaacatctcggcagccaccgcgcttctcccgctggagcgggcgtccagcttggctgccctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctca

SEQ ID NO: 8133 - DNA, 982 bp, Homo sapiens
  ENST00000455477
cagtcttcggggtgctctggatcacggtgctgctgttcttctgggtaaccaagaggaagttggaggtgccgacgggacctgaagtgcagacccctaaggtttggtccttgtttttcaaggtggctgggatgagcccttgggcgcctcaggtgcctgtatcacccactcctccctaccaaagagggcatcttcctacagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagagaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctg

SEQ ID NO: 8134 - DNA, 991 bp, Homo sapiens
  ENST00000464038
aattttgaagacacagtgtttcagagagcgagatggtgactgctgtgattagaaatttgagaagcaattggtggttgaacatgcaatggggcaaaccattttaacatgaattggggatgtgcctgagaagacccaactttcccaaaggaaccaagaacacagccttggaagaaatgagctggaaatatcgcgctcatctaaccactgatgtagagctatagaacacgtgaccagtgacagtctgtgagtggactctccatgtgactaattatgacatgggattatctatgctcctggttccagtttaagaagaaaataagagaaaatcttttaaatttcctccttgatgtctcatcagaattggagccgcttttcctctgcaatactgccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagagaaatctccttccgagtgtggatgtgcgggggcagcctagagatcgtcccctgcagccgagtggggcacgtcttccgga

SEQ ID NO: 8135 - DNA, 738 bp, Homo sapiens
  ENST00000481023
ctggatgacagccccccgagagacacctgtgactgctcccacctgcagaaagaaggcaacaagtaattcactgagcagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgg

SEQ ID NO: 8136 - DNA, 735 bp, Homo sapiens
  ENST00000424136
cagtcttcggggtgctctggatcacggtgctgctgttcttctgggtaaccaagaggaagttggaggtgccgacgggacctgaagtgcagacccctaagggttcttcccaaagttagtgcagcctacacccaggattgaacaaagacagcttggaagttagaagcaagatggagtctgttagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgat

SEQ ID NO: 8137 - DNA, 727 bp, Homo sapiens
  ENST00000496397
agaggtagcttttttccccaccacttggtgtgatgttttacagtttacaaagcatttatatccacagttgcctcatttgatccttactgcgactttgtgaggtttggtccttgtttttcaaggtggctgggatgagcccttgggcgcctcaggtgcctgtatcacccactcctccctaccaaagagggcatcttcctacagacgaggaccctggagcactgatcctacatatctcgctcaagatcacgcagctggttagcgttggagctgggggtgtttgagtccagattggaagcccttacgtactatcccagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccg

SEQ ID NO: 8138 - DNA, 550 bp, Homo sapiens
  ENST00000461193
gttcttctgggtaaccaagaggaagttggaggtgccgacgggacctgaagtgcagacccctaaggtttggtccttgtttttcaaggtggctgggatgagcccttgggcgcctcaggtgcctgtatcacccactcctccctaccaaagagggcatcttcctacagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcg

SEQ ID NO: 8139 - DNA, 565 bp, Homo sapiens
  ENST00000490212
agattccttgatggccactgaaaaattagctggtgcctgtatttcaggcttattgtttcctaggatctcagggagatcaggccacgtggtctgtggattaattaaggcacccagataattggctattaatagatggccaattgatggctgccagctgggtgctgaattgactaatgtccttatggtgggcaggtggtctttatcagaagaggagctagctgaaagactttactaattaaagggtgaatcaggaaaagaagataagaggtagcttttttccccaccacttggtgtgatgttttacagtttacaaagcatttatatccacagttgcctcatttgatccttactgcgactttgtgagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggacctt

SEQ ID NO: 8140 - DNA, 554 bp, Homo sapiens
  ENST00000498206
tttagcaactgctatggcacaagcaccagctaaccaaagtatgtgctggatcataggaagatgatgggtcgtagagtggaggggcatgcaggacaatgggaactgcgagtaggactttggctggtatagtagccccatggtacatctgggatgaagtctacctagagttataggtttggtccttgtttttcaaggtggctgggatgagcccttgggcgcctcaggtgcctgtatcacccactcctccctaccaaagagggcatcttcctacaggaggacaccttgctgtatgtcatttcccatgtctcttgcaagaagctcagttccatttgcagactcaggtctttcttcaagtcagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacgg

SEQ ID NO: 8141 - DNA, 573 bp, Homo sapiens
  ENST00000485468
taaatttcctccttgatgtctcatcagaattggagccgcttttcctctgcaatactggtttggtccttgtttttcaaggtggctgggatgagcccttgggcgcctcaggtgcctgtatcacccactcctccctaccaaagagggcatcttcctacagaattgaaaacagtttgcagctgacacctgagcctacccatttcgttctgaatgcaatttcagcagcccactgtagctcccctgctctccctcccaggcatggaacagccatggcccaagatgagtcgtgtccaaaaatggatctctgagagcgctactgacttgtccaagttcacatcactgttccatcagtggagggactgggacagacccacaggagtgctttttccaccatcatctcagccctcagtagagcaggagtgaggaagcgggaggcttgaggcaagagtgtgaaacatcagacatcacctttgccctcagggctctggagacctcaagcatccacataatatttaaaataataaaaccaatgagtagacaataaaggaccaagatggatatctgggctgtatattc

SEQ ID NO: 8142 - DNA, 4669 bp, Homo sapiens
  ENST00000339732
gaaaggaaaccaggcactgcctgccggctttacatctgttgatctgacctgactggaagcgtccaaagagggacggctgtcagccctgcttgactgagaacccaccagctcatcccagacacctcatagcaacctatttatacaaagggggaaagaaacacctgagcagaatggaatcattatttttttcccaaggagaaaaccggggtaaagggagggaagcaattcaatttgaagtccctgtgaatgggctttcagaaggcaattaaagaaatccactcagagaggacttggggtgaaacttgggtcctgtggttttctgattgtaagtggaagcaggtcttgcacacgctgttggcaaatgtcaggaccaggttaagtgactggcagaaaaacttccaggtggaacaagcaacccaggttctgctgcaagcttgaaggagcctggagcgggagaaagctaacttgaacatgacctgttgcatttggcaagttctagcaacatgctcctaaggaagcgatacaggcacagaccatgcagactccagttcctcctgctgctcctgatgctgggatgcgtcctgatgatggtggcgatgttgcaccctccccaccacaccctgcaccagactgtcacagcccaagccagcaagcacagccctgaagccaggtaccgcctggactttggggaatcccaggattgggtactggaagctgaggatgagggtgaagagtacagccctctggagggcctgccaccctttatctcactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggagccgagtggtatctccggtgatagatgtgattgactggaagactttccagtattacccctcaaaggacctgcagcgtggggtgttggactggaagctggatttccactgggaacctttgccagagcatgtgaggaaggccctccagtcccccataagccccatcaggagccctgtggtgcccggagaggtggtggccatggacagacattacttccaaaacactggagcgtatgactctcttatgtcgctgcgaggtggtgaaaacctcgaactgtctttcaaggcctggctctgtggtggctctgttgaaatccttccctgctctcgggtaggacacatctaccaaaatcaggattcccattcccccctcgaccaggaggccaccctgaggaacagggttcgcattgctgagacctggctggggtcattcaaagaaaccttctacaagcatagcccagaggccttctccttgagcaaggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggagaatgggatgattgtccacattctttctgggaaatgcatggaagctgtggtgcaagaaaacaataaagatttgtacctgcgtccgtgtgatggaaaagcccgccagcagtggcgttttgaccagatcaatgctgtggatgaacgatgaatgtcaatgtcagaaggaaaagagaattttggccatcaaaatccagctccaagtgaacttaaagagcttatatatttcatgaagctgatccttttgtgtgtgtgctcctggtgttaggagagaaaaaagctctatgaaagaatataggaagtttctccttttcacaccttatttcattgactgctggctgctttaaaaaaaaaaaaaaaggatccattgtaccgttgtcttcatcactgggaaatgattattacatagtacagaagattctttgtttttctccactgagcacttaacaattgctttctctctggcctggacattctctggcagcacctccaggatacataaattcaatggatcaatttatttgtcttcaaatggccttaacttggattgtctgtttggccaaccatgaaaattaaagagtgaagcagatgtaatggcctgacattccaaaaactctgaattgggtttattagcacaaatgttgtgttcatttgttgagccatatctcagaagaaggaaagggagctacagaaaggaggtttaggattgcagagaagatgcaagagcactttggcccaattctccagctcaacccagcagctgaaaagcttcaagagatctaggaaaagacattttcatgttaatgagaatttccaccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctctactaaaaatacaaaaattagctgggcatggtggcgcatacctgtaatcccagctacttgggaggctgaggcaagagaatcgcttgaacccaggaggcagaggttgcagtgagctgagatcatgccattgcactccaacctgggtgacagagtgagactccatctcaaaaaaaaaaaaaaagagagaaactctcctgatgccctgttacagggtttgcactgactggagcagaaacagcaacctttctaaaaaagcaaacctttttcctgggaggaaaatgccagagcctgagccaaaattcttatgacaggtaacatttgggtgttaatgtccatgagagctgacagggccatctctgagcccatataactgtctggaacccccaaatgtgtccacaggttgaatgtccatgagtgtgggaagaacacggctcatctggagcacagctgaggctagtaagagctaaatgactttccttgctatgacttggcttacctgaattagctgtaagagttgccgaatgggatgggttctgctatttaataaacagcattcatattcatttttccccagatggagttacctacctttccacatggtcagcttagaaatcttcccctaaagatgctaatctcctttgggctgtctcagaacacagtatccttcaaataagaaaaactgagtgggaagtgcagtgtttccaaacaatacctatcataactacgtattcattgtctacctgctaagtcaagggttcactgcatttctccttcctcagaatacactctggacctgtgctgtctaatatggtagccactaacaaaatgtggccattttgatggaaatccattaaaatcaaagaaaatttaaaactcaattcctcaattgggctggccacatttcaaatgctcactacccacctgtggctagggtctacttctactgtattggcgagcatggatatagaacatttcatcacagttctgttggaccaatctagatagattcattatcccatctagagaagagactttagtcactgtcttcttgcttcagacccatctatatttaaaacaaatttccctaaatcctgagactgagacggagctacaaattctcagatggcgaccgtgtaaatggtattagcggctgaagaaaaaaaatttttcaagacctctgttttttaactgaactttatcattggcattgtgggtctttgaagttgctgggataaattaatataattaaataaaagactgaatttaattgca

SEQ ID NO: 8143 - DNA, 2416 bp, Homo sapiens
  ENST00000437509
gtccaaagagggacggctgtcagccctgcttgactgagaacccaccagctcatcccagacacctcatagcaacctatttatacaaagggggaaagaaacacctgagcagaatggaatcattatttttttcccaaggagaaaaccggggtaaagggagggaagcaattcaatttgaagtccctgtgaatgggctttcagaaggcaattaaagaaatccactcagagaggacttggggtgaaacttgggtcctgtggttttctgattgtaagtggaagcaggtcttgcacacgctgttggcaaatgtcaggaccaggttaagtgactggcagaaaaacttccaggtggaacaagcaacccaggttctgctgcaagcttgaaggagcctggagcgggagaaagctaacttgaacatgacctgttgcatttggcaagttctagcaacatgctcctaaggaagcgatacaggcacagaccatgcagactccagttcctcctgctgctcctgatgctgggatgcgtcctgatgatggtggcgatgttgcaccctccccaccacaccctgcaccagactgtcacagcccaagccagcaagcacagccctgaagccaggtaccgcctggactttggggaatcccaggattgggtactggaagctgaggatgagggtgaagagtacagccctctggagggcctgccaccctttatctcactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggagccgagtggtatctccggtgatagatgtgattgactggaagactttccagtattacccctcaaaggacctgcagcgtggggtgttggactggaagctggatttccactgggaacctttgccagagcatgtgaggaaggccctccagtcccccataagccccatcaggagccctgtggtgcccggagaggtggtggccatggacagacattacttccaaaacactggagcgtatgactctcttatgtcgctgcgaggtggtgaaaacctcgaactgtctttcaaggcctggctctgtggtggctctgttgaaatccttccctgctctcgggtaggacacatctaccaaaatcaggattcccattcccccctcgaccaggaggccaccctgaggaacagggttcgcattgctgagacctggctggggtcattcaaagaaaccttctacaagcatagcccagaggccttctccttgagcaaggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggaggatgagaacagggccaactctgctgctgctgaagcttatcaaaggcctttaacttttcagcagattgtgaacaatgggtaggacatcatttgcttcattcagagatcctcaagaaggcactgccgatcactctcctctaggcacagatcaagggtggcattgtttaatgtcttatttaaataaaatccagaaaaactgga

SEQ ID NO: 8144 - DNA, 815 bp, Homo sapiens
  ENST00000470031
cactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgaaccaacagcatcagcattacctgggagctcaccagaaatgcagaatctcaggccccaccccagacctacttgacctaagtctacatttaatgaggtcccggatggttcaagggcatatggacaccggagaggcactgagctacgtcttggcttctaccaccccgtctttgggttactgtctgctctatgacctgctatcaactgctcactttttgcatgtctaaagctcacacttcttgagatggaggatctggcaggtttctctggccgctagcctggggaggctgtccctgttaggtggaactatggctccaagatgcttcataggcctccggtcagtgttcagaccagtgactcccagtgtgtgcctgtctctggttcagaggtagatgccaggatcagagcaagccaaggatcccctgaacccctccagaagtgagctgtgagagtttggagaacctgcacaaagagaaggggatggcatgtaccttgtgacgtctgtccactgatggagaatgacaggctggcagaatcagcct

SEQ ID NO: 8145 - DNA, 572 bp, Homo sapiens
  ENST00000430410
gctctgcccgaggtgcggcacccactgtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggtagccacggctttcctccaggctcgtctgggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggagccgagtggtatctccggtgatagatgtgattgactggaagactttccagtattacccctcaaaggacctgcagcgtggggtgttggactggaagctggatttccactgggaacctttgccagagcatgtgaggaaggccc

SEQ ID NO: 8146 - DNA, 538 bp, Homo sapiens
  ENST00000489467
acctggctggggtcattcaaagaaaccttctacaagcatagcccagaggccttctccttgagcaaggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacaggtgggtagtcagacttctcaggatggatgatagcccaagaagacttgaaagtgggcgatatttttctgggatgccccatacttccctttgaggtatcttctttctgtggtcccatgtcccttgactgccatggtcccccactgtaatgactcatcacagctctcctcacctcacctccatctgtaagcacagacatgtgccattgtcagaaaataaaagcatcttagttaaaggg

SEQ ID NO: 8147 - DNA, 2775 bp, Homo sapiens
  ENST00000617544
caggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggagaatgggatgattgtccacattctttctgggaaatgcatggaagctgtggtgcaagaaaacaataaagatttgtacctgcgtccgtgtgatgaaaagcccgccagcagtggcgttttgaccagatcaatgctgtggatgaacgatgaatgtcaatgtcagaaggaaaagagaattttggccatcaaaatccagctccaagtgaacttaaagagcttatatatttcatgaagctgatccttttgtgtgtgtgctcctggtgttaggagagaaaaaagctctatgaaagaatataggaagtttctccttttcacaccttatttcattgactgctggctgctttaaaaaaaaaaaaaaaggatccattgtaccgttgtcttcatcactgggaaatgattattacatagtacagaagattctttgtttttctccactgagcacttaacaattgctttctctctggcctggacattctctggcagcacctccaggatacataaattcaatggatcaatttatttgtcttcaaatggccttaacttggattgtctgtttggccaaccatgaaaattaaagagtgaagcagatgtaatggcctgacattccaaaaactctgaattgggtttattagcacaaatgttgtgttcatttgttgagccatatctcagaagaaggaaagggagctacagaaaggaggtttaggattgcagagaagatgcaagagcactttggcccaattctccagctcaacccagcagctgaaaagcttcaagagatctaggaaaagacattttcatgttaatgagaatttccaccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctctactaaaaatacaaaaattagctgggcatggtggcgcatacctgtaatcccagctacttgggaggctgaggcaagagaatcgcttgaacccaggaggcagaggttgcagtgagctgagatcatgccattgcactccaacctgggtgacagagtgagactccatctcaaaaaaaaaaaaaaagagagaaactctcctgatgccctgttacagggtttgcactgactggagcagaaacagcaacctttctaaaaaagcaaacctttttcctgggaggaaaatgccagagcctgagccaaaattcttatgacaggtaacatttgggtgttaatgtccatgagagctgacagggccatctctgagcccatataactgtctggaacccccaaatgtgtccacaggttgaatgtccatgagtgtgggaagaacacggctcatctggagcacagctgaggctagtaagagctaaatgactttccttgctatgacttggcttacctgaattagctgtaagagttgccgaatgggatgggttctgctatttaataaacagcattcatattcatttttccccagatggagttacctacctttccacatggtcagcttagaaatcttcccctaaagatgctaatctcctttgggctgtctcagaacacagtatccttcaaataagaaaaactgagtgggaagtgcagtgtttccaaacaatacctatcataactacgtattcattgtctacctgctaagtcaagggttcactgcatttctccttcctcagaatacactctggacctgtgctgtctaatatggtagccactaacaaaatgtggccattttgatggaaatccattaaaatcaaagaaaatttaaaactcaattcctcaattgggctggccacatttcaaatgctcactacccacctgtggctagggtctacttctactgtattggcgagcatggatatagaacatttcatcacagttctgttggaccaatctagatagattcattatcccatctagagaagagactttagtcactgtcttcttgcttcagacccatctatatttaaaacaaatttccctaaatcctgagactgagacggagctacaaattctcagatggcgaccgtgtaaatggtattagcggctgaagaaaaaaaatttttcaagacctctgttttttaactgaactttatcattggcattgtgggtctttgaagttgctgggataaattaatataattaaataaaagactgaatttaattgc

SEQ ID NO: 8148 - DNA, 630 bp, Homo sapiens
  ENST00000554858
gtcgaaaggtgtcagatggtgagatggcttctagactgggctctgcccactaattagctgtgtggccttgggagaatcatccggcctctcttgctgcccttctttccgatgaaataatgctgacgatgatatttcagggttgtccaggggtcaatgaggcgggatagagggaagcatcgtgaaatctgggagccccaggccagcgaaaaatgtggaagggccgtacccgcactctcctagcactgggtgtgaggcagcgtcgtttccccttcgcgctcttcgaatgtcaagtgcaccagcttccaatccctcctctgggcgggcccggtctggctaatctcagctgcagattccagtacaaactcaggactctcccccgcccagccgcccctacacaaggactcgccgaacacaccttgaatcccgcgccagagcgcagcccggaactgcagctcgcggcgcgggcccaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcctgaccgtagcctg

SEQ ID NO: 8149 - DNA, 579 bp, Homo sapiens
  ENST00000554317
aggactctcccccgcccagccgcccctacacaaggactcgccgaacacaccttgaatcccgcgccagagcgcagcccggaactgcagctcgcggcgcgggcccaggtcgggggtcgcgcgtctccagtcggtgactcaaggccgctcggtccgggggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggc

SEQ ID NO: 8150 - DNA, 604 bp, Homo sapiens
  ENST00000555920
aggactctcccccgcccagccgcccctacacaaggactcgccgaacacaccttgaatcccgcgccagagcgcagcccggaactgcagctcgcggcgcgggcccaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcat

SEQ ID NO: 8151 - DNA, 5708 bp, Homo sapiens
  ENST00000337827
actcggcgcgcttctctcccagtgcgcagtggcctggtgggtcagccggcggcggctggagcgcggggccggccctgcgcacgaatgaatgggcgcccgggggacgcgcgcgctcggggctgaagggcattaggaccgtgaggatcgctccgcgatcctgtctctccctatcacccccccgcccccccacctctctcctttttctgctctgcaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcgggaagggctgatccggtcccgagtgcgtggggcggacgtggctgcagctaccgttctcacctttctggatagccactgcgaagtgaacaccgagtggctgccgcccatgctgcagcgggtgaaggaggaccacacccgcgtggtgagtcccatcattgatgtcatcagtctggataattttgcctaccttgcagcatctgctgaccttcgtggagggttcgactggagcctgcatttcaagtgggagcagatccctcttgagcagaagatgacccggacagaccccaccaggcccataaggacgcctgtcatagctggaggaatcttcgtgatcgacaagtcctggtttaaccacttgggaaagtatgatgcccagatggacatctgggggggagagaattttgagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcagaaatggaggagaaaaggatctttcatccagcattcagtcagtggcctctgcctggagacaaagcctgcccagctggtgaccagcaagtgtcaggctgacgcccaggcccagcagtggcagctgttgccacacacatgacggagggattttcttgaagggtcagctattgcactgtgctgggaggctggctgtggctcctgtttgtgaagagaactcccagttccttttcacagccgctgagaacacatccacacatctaccccacggccttgtcttggaactgctcctgctatccccacaccctgcttcctcaccccactggctcttgggcaaatgactgttggtaccaggaccctgggggtctcccctacaaagcagaccagcctggggcagatatacctaccacaggagccccctgtctttcataggccaaggatccacatacccatagagttcatggattctagagggtctaggaatctcttgaaattgtccctaaaatactgcatgtgtgtgcatacatgcattttcctggggaaaaagtccatggcttctaaaagaggtccctgatccccaaagggcctgaacctctgctctggattgaagccactgtctgcccaagctgccaccccctaatcttcctccctggcgtgctcaaactgccatcgcctgctccctccacacggcccttggggtcagcagccaagtgtctgtggtccgcagcacctgctctggagggctctccagcagtttcgcctcctgactctcaccagcgtcctctcggcagcactcccgtgcccaagtgcacccctctggacttgccagcgcaggccccttcgctcccagggccatgctttgcctgtcctctgtcgtgatgtttcttccgcagccaggtgcagcctcagatcccctgttcatctgggaagcctcctgccacagcttaggacagaactgggcccagggcaaaggcctctccccagaggatggactagaaggcctgggccacactcgggcatggacctttggggctggggagccggggctgcgcctgttgaatgtaagaggactgctgaccagagggccttcaagagggtctctctgtcctttgctgtggtcagatcaggctctgcacttatcagccggtcctttgtggcaacgcagccctgttctgtttttgcttttcctcttcttgaccaaagcatgtgccactagctgtccttgaggacctcgtctttatgaaacacacacctggaataaaaccacttcttacatgtccacatgcaccagcgccttcctttctgcctccaggcctagcccttcagcacaccctcccccgcctcgtggggaaagtccgggcctcctttctgtaaaagtgaaactgaacatgctcaagtctagccctgtcctgcacctggtagcttgctcgtcggcctccatgccctgtggtgccccaggaactcctgactgctctggtgggggccaacaggtggccctactgcaagggcaggccttggaccaaaaccaggaatcagcacaggtcaggtggagcccaggctcctgtggcctcattatgggattctacttggggcttagaaatggaaagcaaattgcttctccaaataggtattgccctgccgccgtgcttgcctttagccagccctctctccttccctgtgagccaggcctgtcccctcggagctgccctcccctgctctaccacacaagaaggcagtggtacaaattcaggcaggacatacttcctgggtaaaaacagcaaaataattctgaaaagagtcttaccagaccagctttgcttgattgggtagcagatgctctgcctaatgttcccatggaaaccaatggaaaacccccaccatgtctgtgatcagaagctgaacctacccaggtaaaaataaacgctgcttcaacatacatatgaactgcagctggcaggccagcacaccactagcctctcctggacgcaaccatttctgccctcagccccactttgccgtggggctgctgatctggagttacccagaacttctgacccctgggcctgaggagcctggagcaaagccctagctggctgcagagaatacaccttggctacaatgtccagcttggtctgggcttaggagcaagtcactgtaaaagaccttggctgcagcctccattcccccatccacccctccgtcctctcagggagcacagcccaccacccaccgcctactcagggctccctcctggcgcgctgagccccatttccactctccatctattttcaccctcagccttggagggctctggtgcttgcttctcctgagtcaggctctctcctcttgcttgctctcctccaaacctacctctcccaaagcccattttctgtgccacccagttttttccctaggagataaggctgtcagcctttagccaggccctggaggaatcagcaaaagccccaggctgggtattaacagttacgtcactggcaggagagtcccccgaaagcctatgggcagggcagcagaagggacttctgcaccagggccagactcccatttgtacagcagggagctgttcctgaggatccctgggcctctgtgacttggcttcagtttttacaagggctgttccccctggcccctcaggaaggctgtctccatctgcagttgggagaaataacctggacaatatgactgtcgtcccagggttccagcaccccaaggcctgcgggggatgtctcccagcactgcatggggtgtggtccttctcccaccagggaacaggaaaggaaacctggaagggaaaggctggcatttataacgtctgtaatttcattgccaacaatgttctcagtgtgtttggtatttgtgtgtccctgtgatggtctgagtcagtgctcctccagaaggagggggcaacccagccagcttctctaatgggaagaggtcttcactgccaggcacttaggaaagacctggagatggatcaggggagggcctactctcctgggcttgcagctgggctgtctgagtagccgacctggactgaggctccagagccatctgaggacaatttctcctgcttaattcagccctgtgaagcgtggagaagagtgtactaggggtgcggactcttgggtctttaagacccattcaagccaggcgcagtggctcacacctgtaatcccaaatattcaggaggctgaattgggagggtcctttgaacccaggggagttcgagaccagcctgggcaacatagcgagaccctatctctataaataaaaattcaaatcaacttcaaaaaatacccattcagctggatccctcactactctgccatttgccagctgtgagctctttttttttttttttttttgagacagagtgttgctctgtcacccaggctggagagcagtggcatgatctccacttactgcaagctctgcctcctgggttcacgccattctcctgcctcagcctcccgagtagctgggactacaggcgcccaccaccatgcccagctaattttttttgtatttttagtagagacagggtttcaccgtgttacccaggatggtctccatctcctgacctcgtgatccacccgcctcggcctcccaaagtgctgggattacaggcgtgagccactgcgcctgactgagctcttgaataagttatttcatctctcagccttgatttctttacctgttaaatggggtactcatagccgtaaaggatttttttgtgaagcctgatcgcaaagcatctggccctttccaaatgcttaatcaatatgtcattactattattaataaacattttctgagtgcctgcta

SEQ ID NO: 8152 - DNA, 5548 bp, Homo sapiens
  ENST00000553471
gcaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcgggaagggctgatccggtcccgagtgcgtggggcggacgtggctgcagctaccgttctcacctttctggatagccactgcgaagtgaacaccgagtggctgccgcccatgctgcagcgggtgaaggaggaccacacccgcgtggtgagtcccatcattgatgtcatcagtctggataattttgcctaccttgcagcatctgctgaccttcgtggagggttcgactggagcctgcatttcaagtgggagcagatccctcttgagcagaagatgacccggacagaccccaccaggcccataaggacgcctgtcatagctggaggaatcttcgtgatcgacaagtcctggtttaaccacttgggaaagtatgatgcccagatggacatctgggggggagagaattttgagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcaggtgagtctccttgcctctggcccagaggcccagcagcccgaggggccatgcctcagggtggcagaccttggcaggagagcccctgattgactcaaataagcccttcagagcgaggatctgtggggagggggagcaaagtctacatctaggtcaagccaattattctgcccatgaggaaatacttctttgggtaattatttgtttaatgccatcctgccaggctgtgagctccatgaaggcagggaccacttgtcttgttaacactgtatccctagctcctgacaaccaccacagttcaaataagtgttagcttttactgacagtctgtgctagaagtttgaaatagatcatctcatctaatcctcccagccacccagtgacgtgggttctagtactacctccattttataagtgagtaagctgaggctcgctgaatctaaagaatatatgtcagatcacacagctgagaaggggtggagctgggattcaaacccaggtcagtgacttctaggcccacagtcttaacccagcacatagtagatgttcaataagtatttcttgactgttggcagactagggaaactgagctccagacacagtgatgtccaagctggcatgaccagcctcacgtgagcactgctttttccattgatccgacactctcacccacactgtcaccactaatcctgggagacaggtcagggtcaaggaagaaagtgatgcacagagaggtggagtcacttgctcagggtacacagcaaccagtgacagtggatttccagaatccagccagctctcttctgtgctactcccttcctgtcttggagggctccctcaccacccagggaatgggacccaaggcccagaggctgctccagcacttcccctgctcaccctcctcagaagccctccctgtgcctgccactggctagcctgcctcagtcggtgcaagcagtgaggagggtgcctgggtctctgatttggcctgcatggttttcctcctacccctttttctttgcttgggtcagcacgttttttaaaggatgaacagcagtttgctgtgccattctggaaagcagccacagcctctccctccggcctgtgtgtgtctgagggatctgtgtgcccagcccacttgctggacctgtgggacactttaagcgcttttggatggtggggggatgcagcccaccctcggccctgccctgcagtggggctggtgcagtgtctcctgcacctagagcacccacctctctgagggcaaatccttgagcccacgcccaccccctcccactgaggaattatctccgagcaaagcctccactcaattgcccctctggggctgaatcacacatttccccctttgtgctgacccagcctacggggtgtgtaggtatctccttggccccattcattctgcccctgcaagtcctgccaggctcccgatggcattctgggtgcctgtgcccctcttctcccaggaggacaggatgagccagctatcccactgccaatgccttctggaatccgggccgtccttcttggtcccctgctggtcctatttccaaggctagctgggtttcctgtatccgagaggctcctgtgcctcagacctggtgtgatggagtcagcaggccccagctcagtcttccctccccctcccttcactcagtctcctcacttataaaataaggggctccctcccctgcttacctcacaaggaatccgcaagaaccaagatgtggagatgggacagtgggtgatgtgacattgtttctcagacaagcccagaattgagtggcctggagagtcaagaagccctgagattgtgcctaatagcactgataagaagtgagaatcccgctgtttggggagcacttcctaatgattgggtgattcagtcattcgttcatcttaaaacaaaatgacggctgggtgcagtggctcatgcctgtaatcccagcactttgggaggctgagatgggtggatcatgaggtcaggagttcgagaccagcctgaccaaaatggtgaaaccccgtctctactaaaaacacaaaaattagccgggcgtggtggcgcgcgtctgtaatcccagctactcaggaggctgagacaggagaatcgcttgaacccgggaggcagaggtagcagtgagccgagatcgtgtcactgcactcctgcctgggtgacagagcgagactcagtctcaaacaaacaaaatgtcactgggtgcctaccttgtgccagagaatgtacagatcatgttggccacaaggatgaacggacatggtccttgacccccagggaatttgcactttagtggaagagaaagaagggagtaagacactatattacagaaggctagatgctgaggtagctccaagcaccacgactccctggggtgaggatggccatactctctccagctgggcattgctggaggtttggcctacatgaggtaaatgtcaaggactagaagagcatgaagaaacaggaggggggatccaaaggcccttgacctttaggctctctgcgggggccatgtgggcccagagaggctgggtctcagccctacccatcacgtccttgcattcccactgggagcccaggctccgcccctgccttccaccctgtgtgcacatccccccgcagccctagccctatccctgcagctgggtgggctcatctctctcccctcagctgctccctgtccaccaactgccctcagagccctctgggcttcctccacatggtcacaagcactcctgcctctaatcgaagacacggtgaatgagagaagatggaagaggggaggtggttgcaatgggaggcaaataggagagaaacccaaactagacctatcttactattattcttccctgagccttgaaacctgggtctctgcctctcatcccttctcataaatgttccaagcaacactccatcctccacccaggcacttccgtaatgttctacaggagcaactcttctcccccttgtcaaacccggggtcggggaggcaccaggaggtgaaggcactgaccaggagcccctgcatgactctgtgatgcgagacctccagtctcccaccaccctgctggccccacacttcatccctacaaagaaggcagcttcccactagggggtgtagattactggcctcacaggtcagaagcttaggaagaataaatcttgtttacagaaataaaagatttacctaggccaggactgacaagctcaagtgcctacagggagctggtgggaaaaccccaataggagaaaagtcgggaccaggcaggaactatggtgacctgcagaacaagagccccatctaaggcagagggcaaatcctcagccccagcaactgatgccatgtaagaaactgggtccaataactacatagaagctggaaatgcagatttgcacgtggcaaccaagctaaattgtaaataaacacaggggacttctgctttgcctcctcctctgatctggacaggaacttctgcaaactacagaaaagcaagagccctgctgggaagggcagggcttaaagctggtgttagaggcaggatgggggcagcctcttacataggaacacacagcctgatttaaatgaggggcatgactgggcatggtagctcatgcctgtaatcccagtgctttggaaggccaagacaggtggatcacttgaggtgagacgttctagctagaccagcctgggcaacatagcaagacccaggctctgcacttatcagccggtcctttgtggcaacgcagccctgttctgtttttgcttttcctcttcttgaccaaagcatgtgccactagctgtccttgaggacctcgtctttatgaaacacacacctggaataaaaccacttcttacatgtc

SEQ ID NO: 8153 - DNA, 2270 bp, Homo sapiens
  ENST00000448469
aaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcgggaagggctgatccggtcccgagtgcgtggggcggacgtggctgcagctaccgttctcacctttctggatagccactgcgaagtgaacaccgagtggctgccgcccatgctgcagcgggtgaaggaggaccacacccgcgtggtgagtcccatcattgatgtcatcagtctggataattttgcctaccttgcagcatctgctgaccttcgtggagggttcgactggagcctgcatttcaagtgggagcagatccctcttgagcagaagatgacccggacagaccccaccaggcccataaggacgcctgtcatagctggaggaatcttcgtgatcgacaagtcctggtttaaccacttgggaaagtatgatgcccagatggacatctgggggggagagaattttgagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcagaaatggaggagaaaaggatctttcatccagcattcagtcagtggcctctgcctggagacaaagcctgcccagctggtgaccagcaagtgtcaggctgacgcccaggcccagcagtggcagctgttgccacacacatgacggtagccctggggcctcctgtaccttttgcatgagacttcgggaccggaagggggttagggtgggggagtgcaaagtgggctgttcccatctcctcacatttctgccaggaccatcagcaaatacccaccatgacacacgttctccaaagcttgttctaggagggcgcaggcgggcacgccccgatgccctcagtgctgtcctggccttgccccgggagaggagatggtcagggtgctggactgttgctgggtagagactgagtaggtgcccctggccctttgtcctctcccttggcgcttcttggggctgggacaatagtgtgtggtctctcccttgttgcccggagaaagcaaggacagaagcccacacaggggtcttttgggtcatgaggcccagctgtgcaggcaggcagggccaggggaaattgggcagcatggatggagaggctgaaggctgggaagagggaaggggagaggggcagcctgcaggggtagctgaag

SEQ ID NO: 8154 - DNA, 1629 bp, Homo sapiens
  ENST00000553669
atgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcgggaagggctgatccggtcccgagtgcgtggggcggacgtggctgcagctaccgttctcacctttctggatagccactgcgaagtgaacaccgagtggctgccgcccatgctgcagcgggtgaaggaggaccacacccgcgtggtgagtcccatcattgatgtcatcagtctggataattttgcctaccttgcagcatctgctgaccttcgtggagggttcgactggagcctgcatttcaagtgggagcagatccctcttgagcagaagatgacccggacagaccccaccaggcccataaggacgcctgtcatagctggaggaatcttcgtgatcgacaagtcctggtttaaccacttgggaaagtatgatgcccagatggacatctgggggggagagaattttgagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcaggtgagtctccttgcctctggcccagaggcccagcagcccgaggggccatgcctcagggtggcagaccttggcaggagagcccctgattga

SEQ ID NO: 8155 - DNA, 520 bp, Homo sapiens
  ENST00000553740
atgttccatcctcacagacactttgggggcaacttcccctgcagttgcccaagccaagtagtcagcaggagcttcatggctgttagctggagcggaaggctggctgcctggttgccacagcaacagctgttgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcggga

SEQ ID NO: 8156 - DNA, 568 bp, Homo sapiens
  ENST00000556677
gttgctgggagctggcgggcacagtggatttcctgtttgggatctggactcccagtatatggacccagccattagttagattggttcgactggagcctgcatttcaagtgggagcagatccctcttgagcagaagatgacccggacagaccccaccaggcccataagctcacgtgttgcgtcttccctctccttgctcccaggacgcctgtcatagctggaggaatcttcgtgatcgacaagtcctggtttaaccacttgggaaaagcactttctatgcgtgaggacctgctctaaggactttacacacatgaggtcatttaattctctcaaggaccctctgagagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcaggtgg

SEQ ID NO: 8157 - DNA, 340 bp, Homo sapiens
  ENST00000556829
agaaatggaggagaaaaggatctttcatccagcattcagtcagtggcctctgcctggagacaaagcctgcccagctggtgaccagcaagtgtcaggctgacgcccaggcccagcagtggcagctgttgccacacacatgacgggcctgaacctctgctctggattgaagccactgtctgcccaagctgccaccccctaatcttcctccctggcgtgctcaaactgccatcgcctgctccctccacacggcccttggggtcagcagccaagtgtctgtggtccgcagcacctgctctggagggctctccagcagtttcgcctcctgactctcaccagcgtc

SEQ ID NO: 8158 - DNA, 2504 bp, Homo sapiens
  ENST00000227756
gctgttctcctagcagcgcgggccggtcggaccgccaaggcagccggcgctggcgatgggaagcggcgtggccgccgacacaggcagtggcaaagtttcccagacgtacacatctggacgcgcggctgccggctacccgtgacccctctaggaagggttcagggatttttaatttggaaaaaaatccacctggtttcctttgtcaaggtctctccgggtggccagcggcaggagctgcaaacttgggcacggcggctacaccggcagcggaccgggctttggagaacctcgggactcaggtgctgaggtgcccagcggctccggacgtgctacggggtgcgagcgcgggggagttcggggcgcacgacaaggaagggcccccgggagctctatatggaggaaggagcccagaatggtgtgcaccaggaagaccaaaactttggtgtccacttgcgtgatcctgagcggcatgactaacatcatctgcctgctctacgtgggctgggtcaccaactacatcgccagcgtgtatgtgcgggggcaggagccggcgcccgacaagaagctggaggaagacaaaggggacactctgaagattattgagcggctggaccacctggagaatgtcatcaagcagcacattcaagaggctcctgccaagcctgaggaggcagaggccgagcccttcacagactcctctctgtttgcacactggggccaggagctcagccccgaaggccggcgcgtggccctgaagcaattccagtactacggctacaacgcctacctcagcgaccgcctgcccctggaccggcccctgcctgacctcagacccagtgggtgccgtaacctctcatttcctgacagcctgccagaggtgagcatcgtgttcatcttcgtcaatgaagcgctttcagtgctgctgcgctccatccactcggccatggaacgcacgcccccacatctgctcaaggagatcattctggtggatgacaacagcagtaacgaggaactgaaggagaagctgaccgaatatgtggacaaggtgaacagccagaagccaggcttcatcaaagtcgtgcgtcacagcaagcaggaaggcctcatccgctccagggtcagtggctggagggcggccactgcccctgtggtggcactctttgatgcccacgtggagttcaatgtgggctgggctgaacctgtactcacccgcatcaaggagaaccggaagcggatcatctcgccatcctttgataacatcaaatatgacaactttgagatagaagagtacccgctggctgcccagggctttgactgggagctgtggtgccgctacctaaatccccccaaggcctggtggaagctggagaactccacagcgccaatcaggagccctgccctcattggctgcttcattgtggaccggcagtacttccaggagatcggcctgctggacgaaggcatggaagtctacgggggcgagaatgtggagcttgggatcagggtgtggcagtgtggcgggagtgtggaggtcctgccctgctcacggattgcccacattgagcgagcccacaagccctacacagaggacctcaccgcccatgtccgcaggaacgctctcagggtggctgaagtctggatggatgaatttaaaagccacgtctacatggcatggaacataccgcaggaggactcaggaattgacattggggacatcactgcaaggaaggctctcaggaaacagctgcagtgcaagaccttccggtggtacctggtcagcgtgtacccagagatgaggatgtactccgacatcattgcctatggagtgctgcagaattctctgaagactgatttgtgtcttgaccaggggccagatacagagaatgtccccatcatgtacatctgccatgggatgacgcctcagaacgtgtactacacgagcagtcagcagatccatgtgggcattctgagccccaccgtggatgatgatgacaaccgatgcctggtggacgtcaacagccggccccggctcatcgaatgcagctacgccaaagccaagaggatgaagcttcactggcagttctctcagggaggacccatccagaaccgcaagtctaagcgctgtctggagctgcaggagaatagcgacctggagttcggcttccagctggtgttgcagaagtgctcgggccagcactggagcatcaccaacgtcctgaggagcctcgcgtcctgacccaccggggccacttccggctgcctctttgctactgtgtagcacctgctgcaacgttgcctgctgtccacgtggggttgtttggagtctggggaaccaggttagtgggcccccaagaagagctttttatttcctattcaattttcatggagtttatagaaagatgctgattggtaggtgatggtatgatatcaaactattttgcagttgtaaataggggacagatggaaaatatttataactgacaataaaatattattaagaaaag

SEQ ID NO: 8159 - DNA, 1523 bp, Homo sapiens
  ENST00000526064
cacggcggctacaccggcagcggaccgggctttggagaacctcgggactcaggtgctgaggtgcccagcggctccggacgtgctacggggtgcgagcgcgggggagttcggggcgcacgacaaggaagggcccccgggagctctatatggaggaaggagcccagaatggtgtgcaccaggaagaccaaaactttggtgtccacttgcgtgatcctgagcggcatgactaacatcatctgcctgctctacgtgggctgggtcaccaactacatcgccagcgtgtatgtgcgggggcaggagccggcgcccgacaagaagctggaggaagacaaaggggacactctgaagattattgagcggctggaccacctggagaatgtcatcaagcagcacattcaaggctataggagaaatttctgccttctgaatgtgtccaactagctctgttcacctgagaaatcacattccccagctctgggtatccctgaataaccacaggagaacagttccaggccctgataagtcagctattgcaagggggacctggctggaagatatgaaggaaaaatatcattcttgaactaataagttgagagatcacagccttcaggggaccagaagggaaggctgaacagggaagggcaatttcacgttcgccatgtccatatttctatcgtcatgagccatctcaccttacaggcagggaagttttgagcttagagaatgggatgcgtcaagaaaaccgtggctcccccagctctgttcctggattcagtgcctgttgtttcatcctgtgtagactggagtcagggtctacacagttggaattctatggaaccaagatgctgtgtggcagatggatgtggactccaactgtgacaatccagaaggccttggggacttgtttcatgaacagctccctgtaggatctctgttggggtgggggattctaggggcatctccgcagttttcttctgaaaacaaaacgaataccagttgggcaggtgcaacaactgtgcatgcagtcccctcccagggctggctagcagtattgttgggtaccgtaagcacttagcattgttaagtgagcataagtaacaagatgcaacagcctctggccaagttttgaagattttgttttaaagtatgcttttagatgttgacattcatgattattaaaaggaacaaaactcaatttggggtctcaagagccacaattctagacttctaggatgtcaggagccatgctcttaagcttctcaccctgctgttttaatgagattaatgattattttccactgagcacctacctgtgatgttcataaaaaagtgaaataaatgactcacatggagatttggaaggatatcactgtggaaagtagatgttaacagcctctagaaatatgataattatcagctatttgagatgcagtcactgtaatgtgataacaagatgtgttgtgcaggtagaaagcatggagagaaatggcacgaagtagttataagaaaaaagaaagaagaga

SEQ ID NO: 8160 - DNA, 3868 bp, Homo sapiens
  ENST00000392701
gctgaaccctgcccgaagaaaccacatgagccagcagttgctgccctcccgaagtggtcctcggaggcagcgcaccccttcattttggcgaaccgaggaggaagggaggaaccgtgtgggggaaatctagaacttctggttccccaaggacccagcagactgtgttctggctacaaggtgatcactgccaccaggtcagtgcaggattcctccaatgtagatgggccgggagccacaacttgcgcggagcagcagcctcgccgaccactcagagagaagccgcgcgacagccaggcttggcccggacggcgcccccaccctgcgcgcgcgatccaaggttctcacctggagcgctcaggtagggctggggcggggcgggaggctggcgcgcaggcgcggaagtggggcctcgcccctgccgacgtcgcaggctggagctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgccttcagtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtatttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttatttttttatctatgtggaaaacacaataaaaaatcctcaacactattgtaatcatttggttaagtttttttcctcttttgggtaaaatctgtaattgataataggtgggggaaaatgaattttgtatgctgaatttctaagcgcctattgtttgtaaaaccatcagatatttcttatggcacaaaaaatgaggaatagcaaaattcctgtgttcaatatttagaaaattttgtattaatttctgataaagttccttaagcatc

SEQ ID NO: 8161 - DNA, 2107 bp, Homo sapiens
  ENST00000409882
actgtaagtatatatgtatggatatggttgtaacattttccctccctctccctctaatttaaaaggtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgccttcagtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtatttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttatttttttatctatgtggaaaacacaataaaaaatcctcaacactattgtaa

SEQ ID NO: 8162 - DNA, 1954 bp, Homo sapiens
  ENST00000412248
acatgagccagcagttgctgccctcccgaagtggtcctcggaggcagcgcaccccttcattttggcgaaccgaggaggaagggaggaaccgtgtgggggaaatctagaacttctggttccccaaggacccagcagactgtgttctggctacaaggtgatcactgccaccaggtcagtgcaggattcctccaatgtagatgggccgggagccacaacttgcgcggagcagcagcctcgccgaccactcagagagaagccgcgcgacagccaggcttggcccggacggcgcccccaccctgcgcgcgcgatccaaggttctcacctggagcgctcaggggttccttcaggagtcacaagtactattgggttggaaaatctgggagaataatagtttacttactgatgaaactgctgtattatcattcattaagctggagcagatcacagtttgagggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaa

SEQ ID NO: 8163 - DNA, 799 bp, Homo sapiens
  ENST00000437849
gtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactcgttttcaactggcgattatagcaatgacagcccaagcaggtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagat

SEQ ID NO: 8164 - DNA, 603 bp, Homo sapiens
  ENST00000463254
gtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtaagtttatggaaattaaatatagcagatatattaaacaatgaaatatattgtgttctaatcggctggtacatatgattacagatgtgtgcactctactttttgtgctttctgaaacttaattgctgg

SEQ ID NO: 8165 - DNA, 540 bp, Homo sapiens
  ENST00000431484
agcagttgctgccctcccgaagtggtcctcggaggcagcgcaccccttcattttggcgaaccgaggaggaagggaggaaccgtgtgggggaaatctagaacttctggttccccaaggacccagcagactgtgttctggctacaaggtgatcactgccaccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacatt

SEQ ID NO: 8166 - DNA, 559 bp, Homo sapiens
  ENST00000414977
agtgtgtcggttgcccctggagagatcccgaaaggggcgccctgggccaaggggcaggtggcgcctcgggggggagcccggtcacaccctctcgcccacggtgcccccgccagtccctatggggcggcccctgaggagctggacggagaccaaagacctggggttccttcaggagtcacaagtactattgggttggaaaatctgggagaataatagtttacttactgatgaaactgctgtattatcattcattaagctggagcagatcacagtttgagggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaa

SEQ ID NO: 8167 - DNA, 536 bp, Homo sapiens
  ENST00000422973
agctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggggttccttcaggagtcacaagtactattgggttggaaaatctgggagaataatagtttacttactgatgaaactgctgtattatcattcattaagctggagcagatcacagtttgagggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcag

SEQ ID NO: 8168 - DNA, 570 bp, Homo sapiens
  ENST00000447156
actggctatcgcggctcatagtatgtaatcgtttcctaaaaagtcctatttttcttttcctttgctcctgttgtcccatattagggtttaataaacttgctgtcctgttcttagggtcaattgcaagcaatattttatcaaaccaaattctgcttttttaactttatgacttctataggctccctacagacacttcaagtaaagctaatgaattctctttttactattagatcttgtatttctgtgagctattaaaactagctgttatataacaacaaattaaatgctgttgattttcttgtttttaggggttccttcaggagtcacaagtactattgggttggaaaatctgggagaataatagtttacttactgatgaaactgctgtattatcattcattaagctggagcagatcacagtttgagggtactaccattaaagataccttcttctcagcaaatctatgataaaaaatataagtaacagaagaagaaataactgttatttgtcaagtgacaagcttttaatgtcagaatggctcacctaaagcgactagtaaaattacacat

SEQ ID NO: 8169 - DNA, 6171 bp, Homo sapiens
  ENST00000259056
gctgaatgaagttttctgggtaatggcatgaaatgttttccttatgagaagtggtgttgagttacagcgtgcagacggagaacggggaggagagaaacggcagtctcaatctggcccccaccttttcttgggcttgtaggaaggtggacatgggctcccggagacaagacaagtgatatgttgaactgttcggtggctggaatcaactgctcctggagtgacctaaggccagtgtttatcagaacttagccagggccagccaagcaggcacagatgctctgctatgaaatgccacgcaggcagagactgacaagcggtaggaactgagctttccccttggactgctgcttcctgctgtgttcaggggagggggtcactttctggcaactctgctgctgctgctgctgctgctgctacttcagcttcctctccactcaaggtaagcaggctaagggagggcaggctgctagggaaagctttgtaccatgaacaggatccgaaagtttttccgaggaagtgggcgagtcttggcatttatctttgtagcttctgtcatctggctcctctttgacatggcagctctccgcctctcattcagtgagatcaacactcgggtcatcaaggaagacattgtgaggagggagcggataggattcagagttcagccagaccaaggaaaaattttttacagcagcataaaagagatgaaacctcccctaaggggacatgggaaaggggcatggggcaaagagaatgttagaaaaactgaggagagtgtgctcaaggttgaggtggacttggaccaaacccagagggaaagaaaaatgcagaatgccctgggaaggggcaaggttgtgccgttgtggcatcctgcacatctgcagaccctccctgtgactcctaacaagcagaagacagacgggagaggcaccaaacctgaagcctcctctcaccaggggacaccaaagcaaacgacagctcagggggctccaaagacctcattcatagcagcaaaaggaactcaggtagtcaaaatatcagtacacatgggacgtgtcagtttaaaacaggagccccggaagagtcatagtcccagcagtgacacatcaaaactagcagctgaaagggacttgaatgtgaccatcagtcttagtactgatagaccaaagcagcgatcacaggcagtagcaaacgagagggcacaccctgccagcacagcagtgccgaagtctggggaagccatggccttaaacaaaactaagactcagagcaaagaagtcaatgcaaataaacacaaagccaatacgagtcttccttttcctaagttcactgtcaattcaaatcgcttaaggaagcaatctattaatgagacacctttgggaagtttgtcaaaggatgatggagctagaggggctcatgggaagaaactcaatttctctgaaagccatcttgtgattataaccaaagaggaagagcaaaaggcagaccccaaagaggtctctaattctaaaaccaaaacaatatttcctaaagtattgggtaaaagccaaagtaaacacatttccaggaatagaagtgagatgtcttcctcttcacttgctccacatagagtgccactgtcccaaactaaccatgctttaactggagggctagagccagcaaaaatcaacataactgccaaagccccctctacagaatacaaccagagtcatataaaagcccttttacctgaagacagtggaacgcaccaggtgttaagaattgatgtgacactttctccaagggaccccaaagctccagggcagtttgggcgtcctgtagttgtcccccatggaaaggagaaggaggcagaaagaagatggaaagaaggaaacttcaatgtctaccttagcgatttgatcccagtggatagagccattgaagacaccagacctgctggatgtgcagagcagctagttcacaataacctcccaaccaccagtgtcatcatgtgctttgtggatgaagtgtggtccactctcctgagatctgttcacagtgtcatcaatcgctctcctccacacctcatcaaggagattctgctggtagatgacttcagcaccaaagactatctaaaagataatttggataaatacatgtcccagtttccaaaagttcggattcttcgcctcaaagagagacatggcttaataagggccaggctggcaggagcacagaatgcaacaggtgatgtgttgacatttttagattctcatgtggaatgtaacgttggttggttggaacctcttctggaaagagtttatttaagtagaaagaaagtggcctgtccagtaatcgaagtcatcaatgataaggatatgagttacatgacagtggataactttcaaagaggcatctttgtgtggcccatgaactttggttggagaacaattcctccagatgtcattgcaaaaaacagaattaaagaaactgatacaataaggtgccctgtcatggctggtggattgttttctattgacaaaagttacttttttgaacttggaacatacgaccctggccttgatgtttggggtggggaaaatatggagctctcattcaaggtgtggatgtgtggtggtgaaattgagatcattccctgctcccgagtgggccatatattcagaaatgacaatccatattccttccccaaagaccggatgaagacagtggagcggaacttggtgcgggttgccgaggtctggctggatgagtataaggagctgttctatggccacggagaccacctcatcgaccaagggctagatgttggcaacctcacccagcaaagggagctgcgaaagaaactgaagtgcaaaagtttcaaatggtacttggagaatgtctttcctgacttaagggctcccattgtgagagctagtggtgtgcttattaatgtggctttgggtaaatgcatttccattgaaaacactacagtcattctggaagactgcgatgggagcaaagagcttcaacaatttaattacacctggttaagacttattaaatgtggagaatggtgtatagcccccatccctgataaaggagccgtaaggctgcacccttgtgataacagaaacaaagggctaaaatggctgcataaatcaacatcagtctttcatccagaactggtgaatcacattgtttttgaaaacaatcagcaattattatgcttggaaggaaatttttctcaaaagatcctgaaagtagctgcctgtgacccagtgaagccatatcaaaagtggaaatttgaaaaatattatgaagcctgaagtgtaactgatgtttttatatagtaaacccattaaatactgtgaaaataacactgaacttggaaactatatttctcagcggtagtttaaattttcaattttaataacatttgaatggaagattttttataaatcacaatatttggaataccaaaagatgactcaggaaaacagtccaacattggactgaagtccttcttcggaactgggtggcctttgaattgcctgctttccaccctatgctagacctcatcatgcaaatttccctgtgaaagctaacaggtaactggaaatgaagacagaaggacttgagaaagcatgaggatattcccaatgactatgtttggtaataatcagctcttctggcccacaagtaggaatgatcaatgagaacttaacttagtcctttatttggggattttttcatcaaacaaaaatttcttgagttcttatggctagaagacctcagatgcccacagctgtcacgtttgtgaaatccctccagactacatgcatgcttacctaacagtttgaaatagtattgatctactgctggtaaccctgcttgatggcagcattttgatctaaattacataatggtttttcccaatctgaatcagtggaaaaaaatttaagtgaggaagaagaggccttcaaatgcttatttaattctaggtatgaacactatttcagttcattttgtgcttttaaaactacagttttaaagatttatgataccaataacttcctagattcatgtggattttttttaaggcaatgaaaaaaggctggattataacacactgtagtaatcaaaaatgcatttaagcattgaatgcactctagtgcagggccaagtaagaggagttgaaatgagtaaagcagaaatagagctgctgaaagtttcttttatataaaaataataaaatactactttagatatagtagcattcacagggatgaaatatgcgaaaaatgggttctaaaatatttcaaagggaaaatgaagtgaaggaaacatcatgaaaggggaaaggaatgaggtaaacaagtcttaggaagagagttaagaaaaaattccgctggacttggccaaagaaagaaggggatctagtatctctatgaaggaaaaaagagtaaagccctcagtgtgaacccagtgagaacactgacaaatttgggaaaagttaaatactgatttcatccaaataaagcctctaatcttaagcataccaatactttggcataccagaagacaccttagaaatcaggatagcctttgcattcattttggtaagaaaactgatgctgagaggataaattacctaaaaatcttaaaacccaggcaagttagtcaaagaatcaagattagaattcaggtttccagagacagggctcattctaatgcctcaggtcactggcccgaacaaatctgcttcacagaattccttagaaagagatacacaattctttgctgggattgggtccctggaggacaaccatactatattcttgttaatatgttttttctttttttaaatttaaacttttgttcagttgagatgattgtgaaactaggtatctttcattctgactcctagtttaacatttaattttgactcccaatgagttacgtaaaagcaaaactataactaagaatgggaaaaagaactatttctgcacatttgtaacatatttaagatgttttcttcatataattgaaaactgcagatgagtaagagaatgactaggaaatgagatacagttatatgacacataatgatgttttagtcaacaatgaaccacatatttgacattggtcccaaaagattatattaataatatggtatctttagtgtgcttttctatgtttagacacacaaatactcaccatgatgttacaatagcctacagtgttcaatacagtaacatgcacaagtttgtaacctaggagcaacagggattccatatagcctaggtgtgtagtaggctacctacaccatctaggtttgtgtaagtacactctgatattcacacaatgatgaaattgcctaatgacacatttctcagaatgtatttgtgttattaaatgatgcatgactctaattcttttcaaaacagagccatatggggcaagggggatggggggacgcaagtcagttgtcaaaagactaattgagttactgacaaactgaacatgctaggtgcctcatgtaattcttcatgtaactaaaaaatgttgagaggtttttttcccccgggtatataggctctctttttatccgaaaatagtttccacaaagaagtcaactctgttctgaaaaaaaatgaattgcattttgaatacacttatctttgggtatatcaactaaaggaagttggatttttttccttaacagaaacttctgcagtcctctcagttcacatcctttctgactttaccctgacaaacttattatataaagctatatttaaatctatattgtcaatataacaaaggattgtttttgaacatcacaaatttgttcttggatagaattttatacattgcttttcatcatatatttgctcagttactctaagaagcaaggaactgatcactagttgggaatctatatgggcctaaacttgagtgtattgatttattattacatctactaccaacattttcttaagcatagccttctaaattttttcaggagattagaataaaggtatacatgctactcggtcttctggtaattctagtgataaacctttggatgagacaggtcctaatcagcactgaattcttcaataggaggctgtgttacaggagctacagatttttccctggattagcttaggtcattgcctttacttt

SEQ ID NO: 8170 - DNA, 667 bp, Homo sapiens
  ENST00000463418
ttgccgaggtctggctggatgagtataaggagctgttctatggccacggagaccacctcatcgaccaagggctagatgttggcaacctcacccagcaaagggagctgcgaaagaaactgaagtgcaaaagtttcaaatggtacttggagaatgtctttcctgacttaagggctcccattgtgagagctagtggtgtgcttcctttttcttcatccaagaaattctttaaaaatgtgaccattagttatcccgcccttttaggccaaattttttcagttcttcttgagagtggattataccatgctttctgtctggaaaatctcctgatagcaaaaacttactataatattcccccttgaaagtattcgggaaatccaggaaagctatgaaagacaagaaactagtcttaaaaaaatggttctgttttttacaaaattcaactgataaataagtttatgtgacctgtttttagataacgcactgtattataaaattgccatttttatgggtccaaatagaatggcagctactttaagtggctcaacctggtaacttatcagacattttggatttatatacactgttcaaataacaacatgtcaaatataactgtaaaataaatttacaatttttaatttcaaccgctgagcagaaaaaaaaaaaagaa

SEQ ID NO: 8171 - DNA, 647 bp, Homo sapiens
  ENST00000461704
aagaagagtgctaggcagagggtaaaggtcacgtaaagccctaagacaggtgagtgttctccatccaagcactggaaagaagacgaatgttgtcagggtgtgaaggagggaagaatggcaccagatgaaggtgaagaggaaggaaggagccagatcacacaggtccttgtaagcaaacttcctttttcttcatccaagaaattctttaaaaatgtgaccattagttatcccgcccttttaggccaaattttttcagttcttcttgagagtggattataccatgctttctgtctggaaaatctcctgatagcaaaaacttactataatattcccccttgaaagtattcgggaaatccaggaaagctatgaaagacaagaaactagtcttaaaaaaatggttctgttttttacaaaattcaactgataaataagtttatgtgacctgtttttagataacgcactgtattataaaattgccatttttatgggtccaaatagaatggcagctactttaagtggctcaacctggtaacttatcagacattttggatttatatacactgttcaaataacaacatgtcaaatataactgtaaaataaatttacaatttttaatttcaaccgctgagcagaaaaaaaaaaaagaa

SEQ ID NO: 8172 - DNA, 5207 bp, Homo sapiens
  ENST00000543196
aacaggccctgctgtgagggaccacgaggcagtgccaggatgaaagagttggagtaacctaggtgattctgagtgaatcagtcaggaggccttcctggagggggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctataagaagcactgtttcaatgcctttgccagcgaccggatctccctgcagaggtccctggggccagacacccgaccacctgagtgtgtggaccagaagttccggcgctgccccccactggccaccaccagcgtgatcattgtgttccacaacgaagcctggtccacactgctgcgaacagtgtacagcgtcctacacaccacccctgccatcttgctcaaggagatcatactggtggatgatgccagcacagaggagcacctaaaggagaagctggagcagtacgtgaagcagctgcaggtggtgagggtggtgcggcaggaggagcggaaggggctgatcaccgcccggctgctgggggccagcgtggcacaggcggaggtgctcacgttcctggatgcccactgtgagtgcttccacggctggctggagcccctcctggctcgaatcgctgaggacaagacagtggtggtgagcccagacatcgtcaccatcgaccttaatacttttgagttcgccaagcccgtccagaggggcagagtccatagccgaggcaactttgactggagcctgaccttcggctgggaaacacttcctccacatgagaagcagaggcgcaaggatgaaacctaccccatcaaatccccgacgtttgctggtggcctcttctccatctccaagtcctactttgagcacatcggtacctatgataatcagatggagatctggggaggggagaacgtggaaatgtccttccgggtgtggcagtgtgggggccagctggagatcatcccctgctctgtcgtaggccatgtgttccggaccaagagcccccacaccttccccaagggcactagtgtcattgctcgcaatcaagtgcgcctggcagaggtctggatggacagctacaagaagattttctataggagaaatctgcaggcagcaaagatggcccaagagaaatccttcggtgacatttcggaacgactgcagctgagggaacaactgcactgtcacaacttttcctggtacctgcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggaccttcctaatccttgcaacaacattgggcccattttctttccttcacaccgatggaagagaccattaggacatatatttagcctagcgttttcctgttctagaaatagaggctcccaaagtagggaaggcagctgggggagggttcagggcagcaatgctgagttcaagaaaagtacttcaggctgggcacagtggctcatgcctgaaatcctagcactttgggaagacaatgtgggagaatggcttgagcccaggagttcaagaccggcctgagcaacatagtgaggatcccatctctacgcccaccctccccccggcaaaaaaaaaaagctgggtatggtggcttatgcctgtagtcgcagctactcagaaggctgaggtgggaggattgcttgttccccggaggttgaagctacagtgagccttgattgtgtcactgcactccagcctgggcaacaggtaagactctgtctcaaaaaaaaacaaaaaagaagaagaaaagtacttctacagccatgtcctattccttgatcatccaaagcacctgcagagtccagtgaaatgatatattctggctgggcacagtggctcacacctgtaatcctagcactttgggaggccaaggcaggtggatcacctgaggtcagaagtttgaaaccagcctggactacatggtgaaactccatctctactaaaagtacaaaaattagctgggcatgatggcacgcacctgcagtcccagctacttgggaggctgaggcaggagaatcactcgaacccaggaggcagaggttgcagtgagccaagacagcaccattgcaccccagcctgagcaacaagagcgaaactccatctcaggaaaaaaaaaaaaaaaaaaagtatattctaacagacagatcagaggtctaagagatcctcccttgctattattacctgaagtctgtagaactgtttacagatatctccttgacaggtgtcctttatcttactttatctgtacagtaatcctgtgagaaagacaggacagaaaccactgtgcctattttacagatacgaaaactgagacacaggtaaaggggcttgtctgtagtcccatagctagcagatggctggagccaagactgaggctcgttcttcaatgctgagccagggctccttccgctgcaccacaagaacgctagaccactcgccaccagccttctcattccctcttcctccattctaatcatttctagctggctggcctccacagagcataggaaaacagccagggccgggcacggtggctcatgcctgtaatctcaacactctgggaggccgagccgggtggataacctgaggtcaggaattcgagaccagcctggccaacatggtaaaaccccatctctactaaaaatataaaaattagccaggcatggtggcgcacacctgtaatcccagctactcaagaggctgaggcaggagaattgcttaaatctgggaggcggaagttgcagtgagccaagatcgcgccactgaactccagcctaggcaacaagagcaaaactccatctccaaaaaaaagaaaggaaaaacagggccaggtagccattgtggagagagcacacttaggaatcctgggatgttagtgttaaaagaaagctcctggagccagtgattctcaggtttgtcccagaacccttttttctaagccccatataaaaggtagattaaaaaaacaaagtagcatgagtgaaattgagagagggacaggtaatgccttccagcccctaacttctaacaatctggaagcacaacgtgaaaatcacgtagcccaaccctatcattttcatattatgaaactgagtccaggtaagtgaatctgtccaaggtcacccagcaaggtatcagtagccctgagggtaaggactctgataaggctcgggagggtcctggaaagcctgaggcggcaggaagagtgtgcagagttgagcgtgtctggaaggctgatccactgctgggcccacatcaaagcccccatggggagcagacccgactgcacatggctcttttgctggaagaagagcatggctgcgcagaggactaaaatttcatctgggaaggcttcttttgactgtcagtagcaggatgtcaccagatgagggtgctatgggaccacagctgtctttgttcccattgcaactcaaccctgcgggaggccgcctacatccctgagagccttctggagcctacagaggagacattggccagccaaaaggaaaggagtggccagggtacgacctggagtagggaagggaaaaagttcccggaaagaagagaattggatgagaggtctcagtggaaataaaggttttctggcattggtcaaggaaactcgcgttgtgttctcttacctgtgttgtcccttagctgaatcagttgatttgggctatgaagaaccacacacatctgaaaagttctgttacagccactgtctcatgtccccaaacattctctggccctaaatctagcttatgtattgtgtcaagcacgtggagacgtgagacgtcaaacgaggtcctgtccccgtggaactcacacgctaaatgtaagcaaatcatagcaagcctggagatgctccaagaggtgctggatgagttagaaggagcaattccttccacttagggaatcagataaggcctcacaaagatggcaatgtttgacctaagacctcggaagatgagtcctcagatgggaagggctcaataagcagagttgttacacaggcagcagcctggcaggagcaaagccacagaggacatgtggccccagtgggtctgagaaacccagaggacattggggtgagggagtgactggtgtagaagctggaagatcagagttacatcatgaatttcaggggccctaggcactttagccttcacggagctcttgctccattcaaaaaaaaattaatgttatgactatgttggtataaagatgaatgtaatccaggctga

SEQ ID NO: 8173 - DNA, 2809 bp, Homo sapiens
  ENST00000356317
ggtccctcctgccttcgctctctgctggtcgcggtggcctgtagctcctccctcggtaggacccccctccaccttggcgcttacgagatgaatgaggagcccagacctctggaacttggagggttgttcagattcccaggctgacaaaaaggagaaacagcttttacttgcatccagggccaatcatcgcagacccagacgtctgcagagggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctataagaagcactgtttcaatgcctttgccagcgaccggatctccctgcagaggtccctggggccagacacccgaccacctgagtgtgtggaccagaagttccggcgctgccccccactggccaccaccagcgtgatcattgtgttccacaacgaagcctggtccacactgctgcgaacagtgtacagcgtcctacacaccacccctgccatcttgctcaaggagatcatactggtggatgatgccagcacagaggagcacctaaaggagaagctggagcagtacgtgaagcagctgcaggtggtgagggtggtgcggcaggaggagcggaaggggctgatcaccgcccggctgctgggggccagcgtggcacaggcggaggtgctcacgttcctggatgcccactgtgagtgcttccacggctggctggagcccctcctggctcgaatcgctgaggacaagacagtggtggtgagcccagacatcgtcaccatcgaccttaatacttttgagttcgccaagcccgtccagaggggcagagtccatagccgaggcaactttgactggagcctgaccttcggctgggaaacacttcctccacatgagaagcagaggcgcaaggatgaaacctaccccatcaaatccccgacgtttgctggtggcctcttctccatctccaagtcctactttgagcacatcggtacctatgataatcagatggagatctggggaggggagaacgtggaaatgtccttccgggtgtggcagtgtgggggccagctggagatcatcccctgctctgtcgtaggccatgtgttccggaccaagagcccccacaccttccccaagggcactagtgtcattgctcgcaatcaagtgcgcctggcagaggtctggatggacagctacaagaagattttctataggagaaatctgcaggcagcaaagatggcccaagagaaatccttcggtgacatttcggaacgactgcagctgagggaacaactgcactgtcacaacttttcctggtacctgcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggaccttcctaatccttgcaacaacattgggcccattttctttccttcacaccgatggaagagaccattaggacatatatttagcctagcgttttcctgttctagaaatagaggctcccaaagtagggaaggcagctgggggagggttcagggcagcaatgctgagttcaagaaaagtacttcaggctgggcacagtggctcatgcctgaaatcctagcactttgggaagacaatgtgggagaatggcttgagcccaggagttcaagaccggcctgagcaacatagtgaggatcccatctctacgcccaccctccccccggcaaaaaaaaaaagctgggtatggtggcttatgcctgtagtcgcagctactcagaaggctgaggtgggaggattgcttgttccccggaggttgaagctacagtgagccttgattgtgtcactgcactccagcctgggcaacaggtaagactctgtctcaaaaaaaaacaaaaaa

SEQ ID NO: 8174 - DNA, 2206 bp, Homo sapiens
  ENST00000603680
aagatggtggccccaactctggtggaccccagaactctgagagattccaggaattaggcaaatcaggattaggtcaggaagcaaggattgcctctccatgaaacctacacaaatctccatgccatggaaaagtaattagtaagtagatgagctcatttatgaagtcacctctcacggtgcctgatgcatattaagcacgtaattgatgcctgctgttactataacgattatgtatttctgttgctgccacactaaaatgaataacaacatactttcccacctaaaacccaaaagaagaaaccagtgggagggatgtcttcagccagcccaccagcatagaaaagggtcacctgccagtcaccccaactcccagcggcccaatcctaggctcctccatgagcctctgacctctgttcaccttcctaggcagccagtgtgctaagggcccaagtgactaccactagccacctagcagccaactatccttgctattaattaacagactgatgctctggtttttatcacctgagggagctgataaactcacatttccaggtcaaaaagccaagtgatcagagctcagagtaggtatacaggcacaggtaacaaaaattaaccagcaggcttttccctaaagtgggccctggtaaacacaggaccctgcagtctccctgtgcttaagtcagagtgaaccaacatcagaaagcctgggatcgtgtagtcatggcctaggaagaagcctggtcggtatcctttttcccagggagagagagcagcatttgcccaagtccttggacctggggtctggtgctctgggaatagaatagagctgcttatggggagactgtctcacctagcccactgaaggcctcatcctgtctcctcttacatcaggtgtggcagtgtgggggccagctggagatcatcccctgctctgtcgtaggccatgtgttccggaccaagagcccccacaccttccccaagggcactagtgtcattgctcgcaatcaagtgcgcctggcagaggtctggatggacagctacaagaagattttctataggagaaatctgcaggcagcaaagatggcccaagagaaatccttcggtgacatttcggaacgactgcagctgagggaacaactgcactgtcacaacttttcctggtacctgcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggaccttcctaatccttgcaacaacattgggcccattttctttccttcacaccgatggaagagaccattaggacatatatttagcctagcgttttcctgttctagaaatagaggctcccaaagtagggaaggcagctgggggagggttcagggcagcaatgctgagttcaagaaaagtacttcaggctgggcacagtggctcatgcctgaaatcctagcactttgggaagacaatgtgggagaatggcttgagcccaggagttcaagaccggcctgagcaacatagtgaggatcccatctctacgcccaccctccccccggcaaaaaaaaaaagctgggtatggtggcttatgcctgtagtcgcagctactcagaaggctgaggtgggaggattgcttgttccccggaggttgaagctacagtgagccttgattgtgtcactgcactccagcctgggcaacaggtaagactctgtctc

SEQ ID NO: 8175 - DNA, 1859 bp, Homo sapiens
  ENST00000603641
atgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctataagaagcactgtttcaatgcctttgccagcgaccggatctccctgcagaggtccctggggccagacacccgaccacctgagtgtgtggaccagaagttccggcgctgccccccactggccaccaccagcgtgatcattgtgttccacaacgaagcctggtccacactgctgcgaacagtgtacagcgtcctacacaccacccctgccatcttgctcaaggagatcatactggtggatgatgccagcacagaggagcacctaaaggagaagctggagcagtacgtgaagcagctgcaggtggtgagggtggtgcggcaggaggagcggaaggggctgatcaccgcccggctgctgggggccagcgtggcacaggcggaggtgctcacgttcctggatgcccactgtgagtgcttccacggctggctggagcccctcctggctcgaatcgctgaggacaagacagtggtggtgagcccagacatcgtcaccatcgaccttaatacttttgagttcgccaagcccgtccagaggggcagagtccatagccgaggcaactttgactggagcctgaccttcggctgggaaacacttcctccacatgagaagcagaggcgcaaggatgaaacctaccccatcaagtgtggcagtgtgggggccagctggagatcatcccctgctctgtcgtaggccatgtgttccggaccaagagcccccacaccttccccaagggcactagtgtcattgctcgcaatcaagtgcgcctggcagaggtctggatggacagctacaagaagattttctataggagaaatctgcaggcagcaaagatggcccaagagaaatccttcggtgacatttcggaacgactgcagctgagggaacaactgcactgtcacaacttttcctggtacctgcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggattt

SEQ ID NO: 8176 - DNA, 567 bp, Homo sapiens
  ENST00000604381
aaacccgggagccaccccgcggcgcggctgcggctttgcctcggcgcgacaggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctata

SEQ ID NO: 8177 - DNA, 554 bp, Homo sapiens
  ENST00000604847
agtaaaatgaaggggctgggccaggctggtccctcctgccttcgctctctgctggtcgcggtggcctgtagctcctccctcggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagc

SEQ ID NO: 8178 - DNA, 476 bp, Homo sapiens
  ENST00000605720
agaaggagcccgcgaccctctccccgggagggcccccctgagctccccgactgctcggacttcccttcggcggatctcgcttctgccgagtcctcgctctcacctcctcctccgccagccttcgcctcttcctcttcctcctcactacccccgacagtaaaatgaaggggctgggccaggctggtccctcctgccttcgctctctgctggtcgcggtggcctgtagctcctccctcggtaggacccccctccaccttggcgcttacgagatgaatgaggagcccagacctctggaacttggagggggaaaataaaagaagcaaaaacaggccctgctgtgagggaccacgaggcagtgccaggatgaaagagttggagtaacctaggtgattctgagtgaatcagtcaggaggccttcctggaggggaccattgcaggtactgtgccttctgcctgaaatgtgctcacctcgcctc

SEQ ID NO: 8179 - DNA, 494 bp, Homo sapiens
  ENST00000605367
ctcctgccttcgctctctgctggtcgcggtggcctgtagctcctccctcggtaggacccccctccaccttggcgcttacgagatgaatgaggagcccagacctctggaacttggaggggtgagagggggacaagccagagccagggctccacaccctcttcccctcacccacccatgccctgcattccttctgtgccccgtctccccagatcgggccaccccatgtgctctggtacggcaactcttgcagagaggtttcctcctgccctgccacgttgcgcctgagcagaaggggacagcaaggagaagcctcgctggtggagggaaaataaaagaagcaaaaacaggccctgctgtgagggaccacgaggcagtgccaggatgaaagagttggagtaacctaggtgattctgagtgaatcagtcaggaggccttcctggaggggaccattgcaggtactgtgccttctgcctgaaatgtgctcacctcgcctc

SEQ ID NO: 8180 - DNA, 372 bp, Homo sapiens
  ENST00000603482
accctcccggccgtccggtggggaaacccgggagccaccccgcggcgcggctgcggctttgcctcggcgcgacagggaaaataaaagaagcaaaaacaggccctgctgtgagggaccacgaggcagtgccaggatgaaagagttggagtaacctaggtgattctgagtgaatcagtcaggaggccttcctggaggggaccattgcaggtactgtgccttctgcctgaaatgtgctcacctcgcctcgctgactcctactcgccagttagtgttcggcccatttctgcccccgtgagatttcttcacagatgttgccctcccccatttgctgagtttcctgcatgccggctccttcagcactcaagggtacct

SEQ ID NO: 8181 - DNA, 555 bp, Homo sapiens
  ENST00000605089
ctctgctggtcgcggtggcctgtagctcctccctcggtaggacccccctccaccttggcgcttacgagatgaatgaggagcccagacctctggaacttggagggttgttcagattcccaggctgacaaaaaggagaaacagcttttacttgcatccagggccaatcatcgcagacccagacgtctgcagaggggaaaataaaagaagcaaaaacaggccctgctgtgagggaccacgaggcagtgccaggatgaaagagttggagtaacctaggtgattctgagtgaatcagtcaggaggccttcctggaggggaccattgcaggtactgtgccttctgcctgaaatgtgctcacctcgcctcgctgactcctactcgccagttagtgttcggcccatttctgcccccgtgagatttcttcacagatgttgccctcccccatttgctgagtttcctgcatgccggctccttcagcactcaagggtacctctttgattctgcttctcacagggctgaggccccagcttgtggccaccacaacgtatcaagctatct

SEQ ID NO: 8182 - DNA, 549 bp, Homo sapiens
  ENST00000605822
attccggttccatgcacccgccgcccgcggctctgctaatgcctgtcctctttggggtgactaggaccctccaatctttttccgcgctgaaagcctggccgcaaagaccgcacccccggggcgggctgagacgcagagaagccggggcgcccctctgccggtccgccgggagttcccgggcccgcagcaggctgaggacacggcgggacccgctgcacctggccagggaggggcggggcgggcgcgttagtgcagctgggggaggtcccgccccggtcccaccctcccggccgtccggtggggaaacccgggagccaccccgcggcgcggctgcggctttgcctcggcgcgacagggaaaataaaagaagcaaaaacaggccctgctgtgagggaccacgaggcagtgccaggatgaaagagttggagtaacctaggtgattctgagtgaatcagtcaggaggccttcctggagggggctgaggccccagcttgtggccaccacaacgtatcaagctatctccagggttgggctcaggactcagagctg

SEQ ID NO: 8183 - DNA, 557 bp, Homo sapiens
  ENST00000603203
aacccgggagccaccccgcggcgcggctgcggctttgcctcggcgcgacagttgttcagattcccaggctgacaaaaaggagaaacagcttttacttgcatccagggccaatcatcgcagacccagacgtctgcagaggggaaaataaaagaagcaaaaacaggccctgctgtgagggaccacgaggcagtgccaggatgaaagagttggagtaacctaggtgattctgagtgaatcagtcaggaggccttcctggaggggaccattgcaggtactgtgccttctgcctgaaatgtgctcacctcgcctcgctgactcctactcgccagttagtgttcggcccatttctgcccccgtgagatttcttcacagatgttgccctcccccatttgctgagtttcctgcatgccggctccttcagcactcaagggtacctctttgattctgcttctcacagggctgaggccccagcttgtggccaccacaacgtatcaagctatctccagggttgggctcaggactcagagctgacgcagctggggtgccccttggttctg

SEQ ID NO: 8184 - DNA, 548 bp, Homo sapiens
  ENST00000605055
aaacccgggagccaccccgcggcgcggctgcggctttgcctcggcgcgacagatcgggccaccccatgtgctctggtacggcaactcttgcagagaggtttcctcctgccctgccacgttgcgcctgagcagaaggggacagcaaggagaagcctcgctggtggagttgttcagattcccaggctgacaaaaaggagaaacagcttttacttgcatccagggccaatcatcgcagacccagacgtctgcagaggggaaaataaaagaagcaaaaacaggccctgctgtgagggaccacgaggcagtgccaggatgaaagagttggagtaacctaggtgattctgagtgaatcagtcaggaggccttcctggagggggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttc

SEQ ID NO: 8185 - DNA, 574 bp, Homo sapiens
  ENST00000604506
agtaaaatgaaggggctgggccaggctggtccctcctgccttcgctctctgctggtcgcggtggcctgtagctcctccctcgggaaaataaaagaagcaaaaacaggccctgctgtgagggaccacgaggcagtgccaggatgaaagagttggagtaacctaggtgattctgagtgaatcagtcaggaggccttcctggaggggaccattgcaggtactgtgccttctgcctgaaatgtgctcacctcgcctcgctgactcctactcgccagttagtgttcggcccatttctgcccccgtgagatttcttcacagatgttgccctcccccatttgctgagtttcctgcatgccggctccttcagcactcaagggtacctctttgattctgcttctcacagggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcc

SEQ ID NO: 8186 - DNA, 626 bp, Homo sapiens
  ENST00000605138
gcggctgcggctttgcctcggcgcgacagttgttcagattcccaggctgacaaaaaggagaaacagcttttacttgcatccagggccaatcatcgcagacccagacgtctgcagaggggaaaataaaagaagcaaaaacaggccctgctgtgagggaccacgaggcagtgccaggatgaaagagttggagtaacctaggtgattctgaaccattgcaggtactgtgccttctgcctgaaatgtgctcacctcgcctcgctgactcctactcgccagttagtgttcggcccatttctgcccccgtgagatttcttcacagatgttgccctcccccatttgctgagtttcctgcatgccggctccttcagcactcaagggtacctctttgattctgcttctcacagggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagaga

SEQ ID NO: 8187 - DNA, 697 bp, Homo sapiens
  ENST00000603563
ggaacttggaggggtgagagggggacaagccagagccagggctccacaccctcttcccctcacccacccatgccctgcattccttctgtgccccgtctccccagatcgggccaccccatgtgctctggtacggcaactcttgcagagaggtttcctcctgccctgccacgttgcgcctgagcagaaggggacagcaaggagaagcctcgctggtggagttgttcagattcccaggctgacaaaaaggagaaacagcttttacttgcatccagggccaatcatcgcagacccagacgtctgcagaggggaaaataaaagaagcaaaaacaggccctgctgtgagggaccacgaggcagtgccaggatgaaagagttggagtaacctaggtgattctgagtgaatcagtcaggaggccttcctggagggggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacc

SEQ ID NO: 8188 - DNA, 581 bp, Homo sapiens
  ENST00000603188
taaaatgaaggggctgggccaggctggtccctcctgccttcgctctctgctggtcgcggtggcctgtagctcctccctcgttgttcagattcccaggctgacaaaaaggagaaacagcttttacttgcatccagggccaatcatcgcagacccagacgtctgcagaggggaaaataaaagaagcaaaaacaggccctgctgtgagggaccacgaggcagtgccaggatgaaagagttggagtaacctaggtgattctgagtgaatcagtcaggaggccttcctggagggggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaa

SEQ ID NO: 8189 - DNA, 582 bp, Homo sapiens
  ENST00000605617
gtccggtggggaaacccgggagccaccccgcggcgcggctgcggctttgcctcggcgcgacagttgttcagattcccaggctgacaaaaaggagaaacagcttttacttgcatccagggccaatcatcgcagacccagacgtctgcagaggggaaaataaaagaagcaaaaacaggccctgctgtgagggaccacgaggcagtgccaggatgaaagagttggagtaacctaggtgattctgagtgaatcagtcaggaggccttcctggagggggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcc

SEQ ID NO: 8190 - DNA, 538 bp, Homo sapiens
  ENST00000604426
gttgctaaggccccaaaagattgcagcacacgaggcagcgccggagaggaccactgagcagcacgggccctggcgggggaaaataaaagaagcaaaaacaggccctgctgtgagggaccacgaggcagtgccaggatgaaagagttggagtaacctaggtgattctgagtgaatcagtcaggaggccttcctggagggggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagccca

SEQ ID NO: 8191 - DNA, 2905 bp, Homo sapiens
  ENST00000511251
tttctcaagtgagacactagagagagtagaaagggaggaagagatagggcgagaagaaaaggagggagggacagagatgaggacgagaaagaagaaaaaagggaaagagaaaataccgtctgaagtccacaggcttatctatcccaagcatgtctaccccacgcatgtgggcatcatatccaggttgtaacaaagaggtgaccatggcgtttatttttggctccagacaggcggattcagcctgcattgcatgcatgcatgtctgtcacctcatctaagtccccattccttccggagttgtgagctccagatccaagagtgcccagtgcacggtgctgggcacgctgtcccttggcgaggctgccacaggttcctgagtgtgcggtcaggggcgttggtgcattgatacgttaggcggagggaggagtaccatctgccagagtcttatctcgagtcccacgttttctggccatcgcggaggagtgtgcgaggacaggtagccctcgcagtgacaaggcgcgcggagtgcggtcgtgcaaggcgggggaggagcggggtggccctgccgaatcttaaccggggccccgggtgtttgcagacccaaataaagccgccttgggtctccacggtgtcctccagaagctgctgcctgagaactctgagcctcagctctgtcttgcttcgggatcctcttcctcctccttccccaccccctacctggcctgaacggcggaacgcgcggctcgggggatcccctctccctgggaccggccctgtcccgggtcgcctccacctcccgcagccgccgcgccccggctcgccgcgctcccgccggcaccatggaggaattcctgggacaaccgcctgcagccggcgacttttccccaggaatctctggcctggcgccctttgggtgagatgacggggtgctggcatccctgtcggtcccagattacccggaaaagccctggcaggtaaagagaggacccgcgcaggctgggagctcccactcctcctccagcgtcacgctcgccctccgccgctgcctcgcgtccgggtctgtttatatagcgtctggaggccgggaggcattgcccacccccgccaggcggcccgccctcccctcctgggctccgggctgccgcacgtggcagacaccagcgacgtctccgcggaaggcaggcgccggggagtggggcgcgggcgaccgtgtgcagccgcggcgcatctccgccttccgctcctcctcgcagcgccctcgtccgcttccaagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagagcgctcacttctcagaggatcgcattccgaggaccgcgcgaggaagggacgtcgcggcgccaccacttcctggctggactccgctgacatctgtagcctcctttccaccaggttcccggggctcccagccgctgcctgcagaggagcgtgtagacagcgcgcgagggtccggcacttcgtggacctccatccgaaccggagttctgcccggatcccgagtccctggatcccggtggagcccgccggcaagctggctccggagggagttgaacttgagttcagatggccaactccctctgaatcctgcagattggtgctgagcacgcaacaaaagtttgtagcttctcagtttctggtgcttcgcaggggagaggaaaggaatttgacattaaacacaagaagcagtcagggagccatctcctttaacttttcttctctgttaccatttgcaatgaagaggaaacagaagagatttctgcagatgactttgttgttcacggtggctttaattttcctgcctaacgttggtctctggtctctgtacaaggataagcacctggtgaagtcagcggagcccggggagcagcaggtaagtgccacccagagaaagatcacacaaggattggtaaggcagtgatcctcgcgcggggactcgagaaagccggtgtgggatcgccttgggttttcccccaagtcttgacagagctgattattacaagactctagagactttggggtttaagcaagtagatgttttaagattgcagccagtaacatcgtgacatgtacaactagtaaagaaggataagacaggtcaagaagaagagaagataatctttcaccattggtcttaggttgattttgacttgaggtggatgaaaggtaactgttcagctatggaggtgggagtgggtttggtgcaagtttaatgacaaggataggtttttgctttccatttggcatgcatgtctatgttcaggtgaattgggccaactaaatcattaagattgtgaagtggttctttaaaaatcaagctatggttttcagtattttggttgtaaattttgcttagcaacagctttttaccctgtcgaaacttaaagtctctctttcgtctcccctgttgctaaggtgctgccatggggcacacaggcagagttattaaggacgttcattccgtttcacagtcgcttgataacagtatgttgctaacagcttgctgtcatattggaaacacccatactaaagatatgtagtataatatgttttctttctacttaatatgtaactcattagtatgtatatacctcatgacttaacatggaccaaaataactgtgttccctggtgaacaataatgcaaaatagacttcccaaaatgttgatgaaaatcaatgttgtcgaattccttgtttgttaataaataaaatagcttccgtaattaaacgttt

SEQ ID NO: 8192 - DNA, 3922 bp, Homo sapiens
  ENST00000506823
gcagcgccctcgtccgcttccaagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagagcgctcacttctcagaggatcgcattccgaggaccgcgcgaggaagggacgtcgcggcgccaccacttcctggctggactccgctgacatctgtagcctcctttccaccaggttcccggggctcccagccgctgcctgcagaggagcgtgtagacagcgcgcgagggtccggcacttcgtggacctccatccgaaccggagttctgcccggatcccgagtccctggatcccggtggagcccgccggcaagctggctccggagggagttgaacttgagttcagatggccaactccctctgaatcctgcagattggtgctgagcacgcaacaaaagtttgtagcttctcagtttctggtgcttcgcaggggagaggaaaggaatttgacattaaacacaagaagcagtcagggagccatctcctttaacttttcttctctgttaccatttgcaatgaagaggaaacagaagagatttctgcagatgactttgttgttcacggtggctttaattttcctgcctaacgttggtctctggtctctgtacaaggataagcacctggtgaagtcagcggagcccggggagcagcagacatttccactgggcctgggagatgggcaattctattcatggacagatggtttgagaagaaaggactggcatgactatgaaagcattcagaaagaggctatgcgctcagggaaaggtgaacatgggaaaccttacccccttactgaagaggaccatgatgactcagcttacagggaaaatggttttaatattttcgtcagcaacaatattgctctagagaggtctctgccagatattcgtcatgctaactgtaagcataagatgtatctggaaaggctgccaaacaccagcatcattatcccatttcataatgaaggttggacttcactcctgcggaccatacacagtataattaaccgaaccccagggagtctgatagcagaaatcattctagtagatgacttcagtgagagagaacacctgaaggataaattggaagaatacatggcccgattttccaaagtgaggattgttcgcaccaagaaaagagaaggactcatccggacccgtctcctgggggcatctatggccagaggagaagtcctgacattcctggactcccactgcgaggtcaatgtgaactggctgcccccactcctcaaccaaattgcactaaaccacaaaaccatcgtgtgtcccatgatcgatgtcattgaccacaatcacttcgggtatgaggcacaagctggggatgccatgcgaggagccttcgactgggaaatgtactacaaaagaatccccatccctccagagctccagagggcagatcccagcgacccttttgagtctcctgttatggctggaggtctctttgctgtggatcggaaatggttttgggaattgggtggctatgatccaggtttagaaatctggggaggagaacagtatgaaatctcttttaaggtttggatgtgtggaggagaaatgtttgatgttccatgttctagagttggtcatatctacaggaagtacgttccatacaaagttccatctgggacaagcctggcaagaaacctgaagcgggtagctgagacctggatggatgaatttgccgagtacatttaccagcggcggccggagtacaggcatctctccacgggggacatctctgcccagaaggagctgcgcaagcagctcaagtgcaaggacttcaaatggttcatggctgctgtggcctgggacgtgcctaaatactaccctccagtggagcccccgcctgctgcctggggggagatccgaaatgtggcagcaaatctctgtgtggacagcaagcatggagccaccggaacagagctgaggctggacatctgtgtcaaggatggttctgaaagaacatggtctcatgaacagctttttacctttggatggagagaagatattcgacccggtgagccactgcatacccggaaattctgctttgatgcgatctcacacaacagccccgttacactctatgactgtcatggcatgaaggggaaccagctctggggataccggaaggacagaacattattccatcctgtgagcaacagctgcatggattgcaaccccgcagagaagaagattttcatggccagatgtgaccctctctctgagactcagcagtggatttttgaacacattaatatgactgttttagaaaaatttaaccaccatgccaactcctagaaagaagaaaggaagaaagagtgattacctacaggttataaattaaattttagccagcatctgggtcgaaggagtcaggaataacatttcctcgatccaggaaggctggtttaaaaatttgcaaatgccatgtcaaagtaggttgttttgaagaacttcctgcatctgaagaacttggctgagaatctcaccagctgcttctgagaactcgagactagcagttcccttgctggccaagggcaaagataatttagggacttttcaaaacaactgctgagctaataaatcctagcatttctcaggtcaaatcctgcagtagtgagtagctatgaatggatcctattaactgggtgggaggggggtgaaaatggagtgcatgactgctctgacaacctgaggatatcacaggtttagaactagccaagcttaaggggtgagctgtactctttggtgccattctctgactaagaatgggttcagcaggtttaacccttaaaagtgctgcagatgatttcagagtgctcacactattctgttttttttatttttatttttaaatgagggtgcaatatctaatgtaagacttaaattacataatgaaatggacatccagtgttcccattctttcgtttatatttgccatttttttttcagagcaaagtttcttttttatgaaagttcatgctccatgaatccactgaatttctaattcagtgcccttctatgaatccagttaaaaacaaaagcaaaagcaaaaatctatgctatcaagttactccaaagaaagatttcacagaagcagcaaaaccatataagatttaggagagggacttccctgggaaatctatttttacttttctattatttttaaaatcttaaaagtctgatatttgtccagtcataatttttattaagcaaggaaatggagtgagtttgatgtaatttgtttaggagattcttaaacccaaataaatctacactccaagtgatatgtgaaaatggcttagttcacttcaattctgtttagtcagtggtgggagcttagaagtggttttatttgttcgtttgtttgggttttgcttttgttttttatttttttcttgttttttttttgtagtgttgaattaatgatgttcttttatttggaagctcataaaaggaattaccattaataaagtgtttctgacaccattttctgttaatgggacaatatttcggggatgaagaaaggaatgctccgaaaactaaatggaacacttaatccttaaagcaattttttactgttcaataatatcacattgggggaagaaaacacaggtatcaaggtggttcttgggaaaaaagaatcatgtttattatatatctctcaagtttttttggtataaaaatgttttaactttgctttctttttggtttttgtttgaagttggttttcctgttaataaaaatttatataaca

SEQ ID NO: 8193 - DNA, 929 bp, Homo sapiens
  ENST00000504379
caagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagagcgctcacttctcagaggatcgcattccgaggaccgcgcgaggaagggacgtcgcggcgccaccacttcctggctggactccgctgacatctgtagcctcctttccaccaggttcccggggctcccagccgctgcctgcagaggagcgtgtagacagcgcgcgagggtccggcacttcgtggacctccatccgaaccggagttctgcccggatcccgagtccctggatcccggtggagcccgccggcaagctggctccggagggagttgaacttgagttcagatggccaactccctctgaatcctgcagattggtgctgagcacgcaacaaaagtttgtagcttctcagtttctggtgcttcgcaggggagaggaaaggaatttgacattaaacacaagaagcagtcagggagccatctcctttaacttttcttctctgttaccatttgcaatgaagaggaaacagaagagatttctgcagatgactttgttgttcacggtggctttaattttcctgcctaacgttggtctctggtctctgtacaaggataagcacctggtgaagtcagcggagcccggggagcagcagtgaaaaaaagaagatggacactttggatgtgaaactttttttgttcttatttacatcattcaacccttgatgtaaaacaggattttaataactttagtagtcaatatgctattatgtaaaatctccactccatgctggtaaaacaggaaaggca

SEQ ID NO: 8194 - DNA, 1135 bp, Homo sapiens
  ENST00000513061
caagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagagcgctcacttctcagaggatcgcattccgaggaccgcgcgaggaagggacgtcgcggcgccaccacttcctggctggactccgctgacatctgtagcctcctttccaccaggttcccggggctcccagccgctgcctgcagaggagcgtgtagacagcgcgcgagggtccggcacttcgtggacctccatccgaaccggagttctgcccggatcccgagtccctggatcccggtggagcccgccggcaagctggctccggagggagttgaacttgagttcagatggccaactccctctgaatcctgcagattggtgctgagcacgcaacaaaagtttgtagcttctcagtttctggtgcttcgcaggggagaggaaaggaatttgacattaaacacaagaagcagtcagggagccatctcctttaacttttcttctctgttaccatttgcaatgaagaggaaacagaagagatttctgcagatgactttgttgttcacggtggctttaattttcctgcctaacgttggtctctggtctctgtacaaggataagcacctggtgaagtcagcggagcccggggagcagcaggaattcaactttggtttgaagtatattctgttttgtcattccagtgaaaaaaagaagatggacactttggatgtgaaactttttttgttcttatttacatcattcaacccttgatgtaaaacaggattttaataactttagtagtcaatatgctattatgtaaaatctccactccatgctggtaaaacaggaaaggcaaaattattttttcttgaaatttgctaattcaattaacaataaccatctgaagtatttgctggtatagctaacataaagcgctaattaattttattaatgagattcttacaactttcacattgactctataattttgacccttaatgagaaaattgtttgtct

SEQ ID NO: 8195 - DNA, 1755 bp, Homo sapiens
  ENST00000508122
atgagagccaagttcagagccggagctggccaccagaggaatccaagcattagtgcagaccacggagtgcatgagctggtttaccagacatttccactgggcctgggagatgggcaattctattcatggacagatggtttgagaagaaaggactggcatgactatgaaagcattcagaaagaggctatgcgctcagggaaaggtgaacatgggaaaccttacccccttactgaagaggaccatgatgactcagcttacagggaaaatggttttaatattttcgtcagcaacaatattgctctagagaggtctctgccagatattcgtcatgctaactgtaagcataagatgtatctggaaaggctgccaaacaccagcatcattatcccatttcataatgaaggttggacttcactcctgcggaccatacacagtataattaaccgaaccccagggagtctgatagcagaaatcattctagtagatgacttcagtgagagagaacacctgaaggataaattggaagaatacatggcccgattttccaaagtgaggattgttcgcaccaagaaaagagaaggactcatccggacccgtctcctgggggcatctatggccagaggagaagtcctgacattcctggactcccactgcgaggtcaatgtgaactggctgcccccactcctcaaccaaattgcactaaaccacaaaaccatcgtgtgtcccatgatcgatgtcattgaccacaatcacttcgggtatgaggcacaagctggggatgccatgcgaggagccttcgactgggaaatgtactacaaaagaatccccatccctccagagctccagagggcagatcccagcgacccttttgagtctcctgttatggctggaggtctctttgctgtggatcggaaatggttttgggaattgggtggctatgatccaggtttagaaatctggggaggagaacagtatgaaatctcttttaaggtttggatgtgtggaggagaaatgtttgatgttccatgttctagagttggtcatatctacaggaagtacgttccatacaaagttccatctgggacaagcctggcaagaaacctgaagcgggtagctgagacctggatggatgaatttgccgagtacatttaccagcggcggccggagtacaggcatctctccacgggggacatctctgcccagaaggagctgcgcaagcagctcaagtgcaaggacttcaaatggttcatggctgctgtggcctgggacgtgcctaaatactaccctccagtggagcccccgcctgctgcctggggggagatccgaaatgtggcagcaaatctctgtgtggacagcaagcatggagccaccggaacagagctgaggctggacatctgtgtcaaggatggttctgaaagaacatggtctcatgaacagctttttacctttggatggagagaagatattcgacccggtgagccactgcatacccggaaattctgctttgatgcgatctcacacaacagccccgttacactctatgactgtcatggcatgaaggggaaccagctctggggataccggaaggacagaacattattccatcctgtgagcaacagctgcatggattgcaaccccgcagagaagaagattttcatggccagatgtgaccctctctctgagactcagcagtggatttttgaacacattaatatgactgttttagaaaaatttaaccaccatgccaactcctag

SEQ ID NO: 8196 - DNA, 3068 bp, Homo sapiens
  ENST00000457021
gagaacttactgtggttgtgagctggacaccacagccctgaagcctgagcaggagcagtgaaaggagggggtttaccatatcatcgcaagctgagaggaaggctgttgggggatacatgcagctggaggaagaatgcttagggcatacgtgtagcttgtttgttctttacaaagcatttgggagatttgccctgagggaaaggtgaacatgggaaaccttacccccttactgaagaggaccatgatgactcagcttacagggaaaatggttttaatattttcgtcagcaacaatattgctctagagaggtctctgccagatattcgtcatgctaactgtaagcataagatgtatctggaaaggctgccaaacaccagcatcattatcccatttcataatgaaggttggacttcactcctgcggaccatacacagtataattaaccgaaccccagggagtctgatagcagaaatcattctagtagatgacttcagtgagagagattggtggaaatcaacaagctgaaaaaactaaagttcaacatatttaaacacttgggaagcaggacctgctcagatccagcatggtgccagcacgttgtaggcctttgctaaaagcatggtgaatggatgaatgaataaatcagatgatgggagtcacagtccacttgcactccaaagtttgagaagcactagtctacgctgtatttgcagctcttgtggactccagcaagaattgtgtaactattgccttctagtgaaagccactgtatgccaggaggcagattctgaggagggtgaatcatcgtggatatagcagagaaaagcaggcaactggtggacaatctagtgccacctcacttcatttccaaagctattcccaccaagtttagcctacgagaatgataagtccacttgctgcgtatgtggagttcaggctgtgtcctcaaatcctctactcactcctttctaggctttccctatcatgtccacatcttccttcctctgccacttcatgtggggtagtggagcgactcctagcggaatctgtgttccattagcattacagctactcactgaaactattgcactctcctcccttctactggctccatcacctgtgttaggagctccctgtaccaagtcttccactttattgagtaaatagttagagccaaagggaacactgtgataaagcctgtgtcagctgccatgttgattttctactgctactgtcataatcacaaagttagcagttaaagcaacacccattttgcaggccagttctctgctctgggtttcacaaagtgatggacggggtgtgttcttttccagagcttctggggatgaattcgcttccaggctcattcatgttgttggcagaattgaattccatgagattataggactcaggtccggtgtccctgccagcaatcagcccagggttggttgttctcaggttttagaggctgcccacattctttttggggtggcatcttcctcctgcttcaaagccagcaaagacccttcacagtagttcctcgattcacgttagattaaatcagcagggagcaggaattttgtgggacatcttttgaattctgccttgtgcagctgcactatgcaaatgattaggaaaaactgcaagttcttattttgaagtaattttccaagtgcctgcagtacatccttactctcactcctgcttatcactgggaggattttatatggaaagcacttccctaactttttaggaactccctgttttgcctgtgatgaaccactcagcattttcccccgcattaaattacaatgacttcatttgaaacagaaatgcctcaaattttgggatctacttatgatagccttccctcttgaccaggactcaaagtctattttgccctaatgtgtctttggtcaataaaatggaatttggagagtttgagaaggtatatttgtaatttcaatccctgtctagaaagcatgaaaaaagatattagaaaaaaatgtgttgctcttgagtattattgccattgatgagttccacagtgctagtagactacattaggaatttgaatgaagcagaattgaatgaattctatttttaaaaaaatgaattgtacattacagctcacaagtatccaagagctaaatttgaaatgtcaaaggttatgtaaatcttatatgtttagctaaccctgtaatgagaaagactcccaacactgaagtctcaaatcgtttttgagaacactgaggagagaagccacataatttgagagtgtcataaccgggagtcctagaaagaggaagatcaaacagccgatgtgaatttaggccatgaagaggtttaatttaaaagctgagagcaaaatcacagtcctttcataattattataaggagatattgggtaccctcactctggcagacctgtggtgcctaatgaaaagagagcatttctctcctgcttggcttattttatccctaatcagcagcggtacttcaaattagcttcacaatctattggcctctctcagccataaaagcctcttttctcttttgatattagcatagctccccattgaaagtaacagaaaaagagctcctacttgaaggttatatccttccttgtggatggcccacttcaaagggttcatcacatggtccaaagagaagtaaaaataagatgaggggagtgcagcagctgtgtttctaagacaagaggttctgagctgaagaacaccacatcgattaaggtcagggcagctgggaaggttgcagttcagccaaaagagggctgaagtactgaacttgaaaactctagaacctgggaaatgtaagcattaaactcagagacattttatggaaaaaaaaaagttttattttatagattcagttctgtaatatagatattggaacattaaaatgatctgaggtattgacttcaaaatccatcatttggggtgttggattatctgttatttacttaactccattagcacccagctatggataaattgtgtgtaatagttgtgttttatgagatcaagattttaaaatagtgaccactg

SEQ ID NO: 8197 - DNA, 1254 bp, Homo sapiens
  ENST00000616459
gaacacctgaaggataaattggaagaatacatggcccgattttccaaagtgaggattgttcgcaccaagaaaagagaaggactcatccggacccgtctcctgggggcatctatggccagaggagaagtcctgacattcctggactcccactgcgaggtcaatgtgaactggctgcccccactcctcaaccaaattgcactaaaccacaaaaccatcgtgtgtcccatgatcgatgtcattgaccacaatcacttcgggtatgaggcacaagctggggatgccatgcgaggagccttcgactgggaaatgtactacaaaagaatccccatccctccagagctccagagggcagatcccagcgacccttttgagtctcctgttatggctggaggtctctttgctgtggatcggaaatggttttgggaattgggtggctatgatccaggtttagaaatctggggaggagaacagtatgaaatctcttttaaggtttggatgtgtggaggagaaatgtttgatgttccatgttctagagttggtcatatctacaggaagtacgttccatacaaagttccatctgggacaagcctggcaagaaacctgaagcgggtagctgagacctggatggatgaatttgccgagtacatttaccagcggcggccggagtacaggcatctctccacgggggacatctctgcccagaaggagctgcgcaagcagctcaagtgcaaggacttcaaatggttcatggctgctgtggcctgggacgtgcctaaatactaccctccagtggagcccccgcctgctgcctggggggagatccgaaatgtggcagcaaatctctgtgtggacagcaagcatggagccaccggaacagagctgaggctggacatctgtgtcaaggatggttctgaaagaacatggtctcatgaacagctttttacctttggatggagagaagatattcgacccggtgagccactgcatacccggaaattctgctttgatgcgatctcacacaacagccccgttacactctatgactgtcatggcatgaaggggaaccagctctggggataccggaaggacagaacattattccatcctgtgagcaacagctgcatggattgcaaccccgcagagaagaagattttcatggccagatgtgaccctctctctgagactcagcagtggatttttgaacacattaatatgactgttttagaaaaatttaaccaccatgccaactcctag

SEQ ID NO: 8198 - DNA, 10044 bp, Homo sapiens
  ENST00000299727
atggagctggcggtcgggaacctcagcgagggcaacgcgagctggccggagccccccgccccggagcccgggccgctgttcggcatcggcgtggagaacttcgtcacgctggtggtgttcggcctgatcttcgcgctgggtgtgctgggcaacagcctagtgatcaccgtgctggcgcgcagcaagccgggcaagccgcggagcaccaccaacctgttcatcctcaacctgagcatcgccgacctggcctacctgctcttctgcatccccttccaggccaccgtgtacgcgctgcccacctgggtgctgggcgccttcatctgcaagttcatccactacttcttcaccgtgtccatgctggtgagcatcttcaccctggccgcgatgtccgtggaccgctacgtggccatcgtgcactcgcggcgctcctcctccctcagggtgtcccgcaacgcgctgctgggcgtgggctgcatctgggcgctgtccattgccatggcctcgcccgtggcctaccaccagggcctcttccacccgcgcgccagcaaccagaccttctgctgggagcagtggcccgaccctcgccacaagaaggcctacgtggtgtgcaccttcgtcttcggctacctgctgccgctcctgctcatctgcttctgctatgccaaggtccttaatcacttgcataaaaagttgaagaacatgtcaaagaagtctgaagcatccaagaaaaagactgcacagacagttctggtggtggttgtggtgtttggaatctcctggctgccgcaccacatcatccatctctgggctgagtttggagttttcccgctgacgccggcttccttcctcttcagaatcaccgcccactgcctggcgtacagcaattcctccgtgaatcctatcatttatgcatttctctctgaaaatttcaggaaggcctataaacaagtgttcaagtgtcacattcgcaaagattcacacctgagtgatactaaagaaagtaaaagtcgaatagacaccccaccatcaaccaattgtactcatgtgtgataaaagatagagtatccttatggttgagtttccatataagtggaccagacacagaaacaaacagaatgagctagtaagcgatgctgcaacttgttatcttaacaagaattcaagtcgttttaattaaatcccacgtgtgttaaaaagtactttgatccatttaggaaattcctaggtctagtgagaattatttttcaattttattttagttctaaattatgtttcagaaacaaaagacaatgctgtacagttttattcctcttcagacatgaaagggaacatatatattccatatatatgttcaactcttcatagattgtgaactggcccatcaatatggtcaggaatatttgcagtctacattttaaagccaatttatttagaaaaaaaaatttgagctttaattctttaattttaagagaagtaatattgtgaactatgtattttaaaatatgatcatggacacacaatgatgaattttttggccatttacatagacatatctattaagtggaaagaaggctttctgaagtctgtttgcacaggtggcatttgcttccaattgtagctagcgcacagagctttggaagcctgtcattatgagatacagtcggtttacctcaggagtcaattcagtgttgtactggtgacctgggatgcagtagtaggcactgttgattcaaatttatcctgtgaaactggctttatagagttaacaaaacagagtcagagaccactgtcttaacagtggaagatgcaaataagtttttgagaataaaactggattttgaaattttacattagtacttgacaaaagttttcattttgccttgaatggaacctactaaaaagagagatgaaaaaaaatcagcgaggttgatgtagataataatttctatgggaccaaagactagacagaattcagtaagtcacatgaagtaatggtcatgcctgtacataaagcatatttcatgtttgatttagatgacattcaaaaaaaatcatgggactgaatatacctggggtatcctatcttgtacaaatgcatgctttttcattaaatttgtaatgatgtttaatgaacatttccaccaaacattatttcctctaaaaatgttaatttggggttaaaaccatcaccatttgaatttcaaatgtagttttcatgacaattttatattgatgtgtgtttacaatgagaaaatggcatgaaaatattaaattgtcttgtatcggaaaagtacttttcagactgtaagactttgatatgttttaggaggcaacaaaagcaagaagttttttttttgtttgtttgttaaaaaggatttggccaagcacagtggctcatgcctgtaattccagcactttgggaggtccagctgtgtggaatgtacttgagctcaggagtttgagaccagtgtgggcaacatggcaaaactcggtctctactaaaaatacaaaaattagctgggtgtggtggcgcacgcctgtagtttcagctactctggaggctgatgtgggggatcacctgagcccgggaggtccaggatgcagtcagtcaagactgcaccactgcacttcagcctggatgacagagtaagactctgtctaaaatatatatatatatgtgtgtgtgtgtgtgtgtgtgtgtgtgtgtgtgtaatgtacctctgtgccaaatcagcactccacatgaaacatcaaattttagataaaaatgcaaacttgacataagcctttggcatgctaatttttttagctcattcacttactttcactaatcatatttcagtgactagtgtttacatttgcaatgttattaataactctctggataaaaggaaagaaaaacgttagaaagattttgaagtgatgtattatgtttgttgactagaagaagaaattgtgtttatgtgtaagtgagggtcttaaagaatatgtcctttgcatcgaatgttttttgcactttattcaaatatataggagcagaaaaattttatcctgacgatgatacttcctgtgatttgtggaacttgaagttgctgttgcaaactccagaacaacttctttgggtgtgaactcacaaaactgtgtaaagaagtgccttcttgttgtgtttgagtttgcatgaatggaaatgatttcttgcaccatggctatttctttgttttctccttctgatctgtaagcatataaatggaagtatttaaaaaaatactgtagctaatgttgctattttctagaggcatgccgaaaatgtgctgtgcctttggtccttcccagatgctactggcacgtctgaagcttgaggcatggtacaaaaagtaatagcttgcgcttgaaacccccccccccccgccactttgctaaatgtaaatgctaattgttgcattttacagttagataggatatacttcctgcatattgtcattctaatcaattcctcttactcagagttttggctgagtctacttctaaaacaaattttgatagggataatgacatcttctgcaaagatctaaacctctacaaaattttctgaataaagagtttcagaagaactcgtaaacagaatgaaattaaccagagaagtataggagtgtgttgcgtttgccaagcatctgcttcccagctagatttccccctaatatacaatgaccaattctgaagcaccttcttttccgtcactaaataaagacagcttcccaaggacacactttttctcccagcatcaggttgagggagaaatattgcttatacctttgaagtcaggctgcttgaaactcacattttcagtttacttcaaagaaaactgatgctttctaagcagatttggctgtctcagtgcccaaggcagctgttattttcctaggctttttgctttcacgtaaggagacaggctttgggatatttagtagctgaaatgcttgctgtttcacatgcataagcaaccatttcagtgtcctgctgatgaatacagtgatgtggatggaaacgttttcttgtcctatatcctggggataggaaacagattctctgtgctcttctgaccgggtatgtactcagcaacatgggggactgaggccattttctgaatactttaggtaaattacttttgcttttaactaaattgttttattttacacattgggagtaaaaccatttccgccccatcccaatctcttgtgcttttatcttttttatcctaactcacttctatccagatttcctctcgataatatttaccacagataaattcatctttcagcgcagatataacaaatcagagtggggaggagagatgcttaaggaactgcatgagtcatgcaaggctcagaacttcttgtggctcaactcgaaatcatattgcattcctgcattctcccagatgctttgaggcagtgcagcgatcattctaatatgttaactgagacccaagatctcagcaggagaggacagcttatccaagcatccctttccttttcagtcatggccatggctatctgtaaacaccaaaatgctcatgctgaagcagcattacattgaggaaaataacctattgggcagcttcatcatgttcttgctttaaatgatttatcaaatacatgtatgtaaactacatagtcactaactgcgaaaatacatcaatgtggctacttcctctggaaagttactgtctaaaatttgtaaattttaatcttcactgttgcacatattttccatgtcttaaatttgtaagtgggtttctatgaaaggtaatcgtattcttcttgaccattaaaaatgttgcatgtaaggctatttctcaagtagatgttaatgacttgtttaattattgacttacttattttaaaagctgtatgtagtaagaacaagtaggtggtttaaaattcagatagttacatgttggcctggaaagaacaaaattatgaaatggtaattatatctgattttatttaaccatattttaatattttctcttttagaagtggaaaagttgagcctgaggaagaatttaaaatgcttaagacatctttgatgggggctgtatttgcattaggcagaggtgtctaaggagagtgtatcgtgtattgtgatgcattagcaggatgttttgttcatcgacttgtgaaagtgctgtggataatagatggtggtttcttttcttagtgtggcaggttcactcacattcatgtttttgactttagctgccatcctggggttctgagggtagcatgtctgtttgactgggcaagaccctcacataccttggcaggccctggctttcgtttctctgtggtgcctggtgctactcacagggctgactcacgggcagatgctccccatccttccccataggccctgttcccgcatccgatgattctcaggttttgttctaggtgcagaaatagtgggagaggccataatcgtgaatgatgaataagaagggaaggtggggccgggcatgtgacttatgcctgtaatcccagcactttgggaggccgaggcaggtggatcacctgaggtcgggagttcgagaccagcctgaccaacatggagaaaacccgtctctactaaaaatacaaaaattagctgggggcacacatgtgtgatcccagctactcaggaggttgaggcaggagaattgcttgaacccgggaggtggaggttgcaatgagcctagattgcaccattgcactccagcctgggcaacaagagtgaaactctgtctcaaaaaaataaaaattaaaaaaaaaaaagaaggtggccagtgagggttttatctttgtattcactggaaataacctcagctgaattttctctctgaatcttttcaatgttggctccatttgccatactcagacaattgcttgaagagctgaactgttagctcaagatttcgttggcactgttggatagaaagcctctccttttctgctggagaagagatttctcaggccaagttgtgtagctccaaattctccgcaattagagaaggcacagtaaagaaaagatcccttgctgatggaatggactggaactgagctccactgtttaaatttttgactctcaggtagtggtgatcgttatggtaacccatgaactcggatgaatttcggggcctgctgtgggttttctatgggacaccatataccacagtactgtatttcaaaatattggatattgattatgaacactggaactatttatgtgtcatcattccaaagaccattgtgatctatgaagctcctttatttgctggctagattgtccaaaaacaagctcacttgtttttgggcaatctagccaaggtgtcacataatggagaaaaatgcagatggtcctgtggctggtgtgaatgaagaatgacctgggcccaacatagaacttttccagtatggtgagcatcaaagtaggcagacatccaaaagccaagtgaagggcagatagatccccaggtgccacccaggctctgcaggcaaagctctcagggccccatttgtgtttgtgtggcctgcactgtgtaagtgtcgttcccctaggacttctgcaatgggataccaaagatgacgtgtaaggccttcagtatataatggacttgtgccaagtacctaagggttcactgccttgtttgaggaatcgcagagcatcatttctgattggttcttagagcctgcatcttgtaccactgggacttctggagacctctggggaccgttgactatgctgggagggtgcagaaatgaagctgatggcagaagcaggctcccagctcctcttcttctgctcagccaggtgattcttacctccattggcctttggatgtctgcgtaataatttgttgagaatcattagagaacaactaatccaaaaaatctatcatcctttatttgtgttgactttctgattatgccttcattcactctttttattacttatacacatgtctgtttttattcttccctactcttttcttaaagttggtcatatttctacacttgagatcttccagtttctgtgaatgttgaggggttcacaaagtggcttggcctcagacctctatatccttgttgttctgtttggacttaggacttttttcctggctatcctgccaatacttttccatctaacagaaacgcaagcttcaagagcaagttatttttataacagatcatgtgagcaattcctccatagcattggttgtagaacaggtcagttggcatgtggcctcctgagggccttgcatggggttctggacccagcgggggccacatctctgagaattcgttccctgtgggtgtctggggtgcatcgttacttctgagatgttatgactcagcagatgagatttgtccgtctgctcagtgagaggaattccaatgctgggtcttgactcccgctgcagggagctctctgggcccgggcatgttggatggagttgtgatgggtgtgcctccctcggacttactctggccaggaactgcatctgctcctctaaggagatttgagcaggtgaatggagtttctgtcattcctggtctagagttcatgtgtgaaggtcaaatataggtggggacttggcagcacacaactctgagtgaaagacacgatcagcgtgatagacaggtgtcttgctatgtgacttgccattgcggtcactggttatacaaagtctctgtttagaaatagcaaagatccaagaaagcagaagagtgggggtgggagtggggctaaatgtgttgctcttcagtggaaatctgcccattttgttgaaaagaaaggaaacagggtacacaaatgctgtttgggaacattgtgtcaggatcacctagctttgacgatgagagtgttttttaaaacggaaaccatgtcattttccttctagagagaatttcctggtatgtcaatgtagcttcagaaataggtctcagtgttctggctcagggcgaggttacaaaagaggcttcggtagcgtcctcaggcccgcgtgccctgtgttcttaacagcctcatggggcctagaggaacttttacatggtagacactgagtgaatacacagattcctagatttgagatattttcaaaatagggctagcatgtataaagaatcaaacttagtcattccattgaagtgaaattggattataatttagaaatatttataagccagaaatggttgtgtaaatgttagttttcatattttggttttctaagagtcacattttattgccatatagcacaaaatttgacaatgaggtatagaaatccaaaattttcttgggtacaattgaacaaatcttttaatctcttcagttctatctgcctaagtgaggagagtagttgtggagcattgtagaaaggataaaatgaacattaggatactgagggtttggtctgaattctgttttttcattgctactggaagtgctgtctttggtatcctcatgcatacaagaaggatttggaaaatgtcagtgagtttgaaactggctgtacagttgaatgagctgggcagttgaaagtacccgtgatgctctggccttaccttagatcagagattcttatattttatcaagcatcagaatcacctgcagagcttgttgaatgcagattgttggccacatctccagaatttctcattcagtagatttgggatggagcccaacgatttgcagctggtccagagaccaccttgtgagatctactacctgatttaattggtttgaaggtgaaggtggagtccaggctttttaaaacagtgtctgtattttcagagcagataaccaatcaaattgagcagatggtcttttaaagtctaagcttctatggttctgtgaaaaaaattgtttacatggaatttaaatcattcagaatttttattgcttacattgatcagatccataaaatatctgtttaactattacattaccctagctacagaaatttgtaagttttcaaaagcatgaaggagtttaataacttgtaagactttcagagattgttataatttttgcctcaaaaaaataaaataaaatagcttggtggaaaagagcacctatgcattcaatttgtttccctcaaatgctaagggttaaaatagtactcaaaattgttagatgtgaagttttgaacccagtgtttaaactcagtgtttaaatatttgcatgtctttctatgtgactgctaatttttaactacattattatctctaagagataaataaactttccctgtacttaaagtttttaaattaagtatcttctgataacataagtagtatgagtaaggaaaaaaaatctatgtgtactgtatttttaaattttaataaggtttgatatggtttggctctgtgtctccacccaaatctcaccttgaattgtaataatcctcacgtgtcaaggaccagcaggtggagataattgaattatggggccggtttctctcatactgttcttgcgatagtgagttctcaggagatctgatggttttataagcatctagcatttcccctgctggtacattctctcttcgcctgctgccatccatgtaagatgtgacttgctcctccttgctctctgccatgattgtgaggcttccccaccacttggaaatgtaagtcaattaaaccactttctttagtaaattgcccagtctcgggtatgtctttatcagcaatgtgaaaacggactaatacaacgtgattgtttaaatgctgatatgaaagcagtgctgaatgtggatcttcttatgccagatactgttataattattctctagagagctggccatacaatttatctcattatttatagatctagcatgaatgccagtaagctgacaaagccaaaagccaaaaactaagagtttgtattaatccagttaatgccaaatctagtcatcctccatcatcctacctctgtgttctgcatgaaatataattggcctttgtgatggaaccagttttcttgcattgaaaataaaatttgttcctc

SEQ ID NO: 8199 - DNA, 315 bp, Homo sapiens
  ENST00000582943
ctgaaaaaacacagatggctaaaagggaacctgaggttatgatgctttaaataaacaaaaaaacttaagacaattgcattccagagttgccttttgcctccaaattctcacaagtttgtaagggagcagtcttttgcaccagacagtttctgggaaactcatcgaatacatgggtgggaggatgagtcgaagtggtctgcccagtgccccctgaagagccctcccctctgctgctatggagctgttcttcaccaggtccttaatcacttgcataaaaagttgaagaacatgtcaaagaagtctgaagcatccaag

SEQ ID NO: 8200 - DNA, 1691 bp, Homo sapiens
  ENST00000305124
tccgagaaagagacggagagagagggaagaaaaagacagatagatagatattggggggaaggagaaaaaaggagaagagagggaagagaggacagcggagagagagcaccagagagagagggagagagagagagagcgctagagagagggagcgagcatgtgcgatgagcaatagctgtggaccttacagttgctgctaactgccctggtgtgtgtgagggagagagagggagggagggagagagagcgcgctagcgcgagagagcgagtgagcaagcgagcagaaaagaggtggagagggggggaataagaaagagagagaaggaaaggagagaaggcaggaagaaggcaagggacgagacaaccatgctgtgctgtatgagaagaaccaaacaggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaacttgcggctctaaggctcctttttcaacccgaatattaataaatcatgagagtaatcaaggtccaa

SEQ ID NO: 8201 - DNA, 1901 bp, Homo sapiens
  ENST00000393780
acagttgctgctaactgccctggtgtgtgtgagggagagagagggagggagggagagagagcgcgctagcgcgagagagcgagtgagcaagcgagcagaaaagaggtggagagggggggaataagaaagagagagaaggaaaggagagaaggcaggaagaaggcaagggacgagacaaccatgctgtgctgtatgagaagaaccaaacagaattaaaagggaacctggtctctgggttgttttcaacatctcaagtgtgaattttccctgtcaaaatcttcacaaggaaaatgagtcacagcatcacctgggtgacgaggtcataacacctcagcccttgcttaaaaaattttatttctacttttctattgtaaagagatctcaaaacaggaagataaaattggactgacagctctacagcctagtcttttagacagtgaactaggccagcattggcagacactggcgatgacaaagtcctgctctgaattatgccaccccgcactccactttttaccttgcctgggaggcttgaggaaaaatcttcagagagcagttcgacctagtccttattcacttggcttcttgactttctggatttcaagggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaacttgcggctctaaggctcctttttcaacccgaatattaataaatcatgagagtaatcaaggtccaa

SEQ ID NO: 8202 - DNA, 1875 bp, Homo sapiens
  ENST00000229239
gggggaagtgggggctgggaaggaaccacgggcccccgcccgaggcccatgggcccctcctaggcctttgcctgagcagtccggtgtcactaccgcagagcctcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacca

SEQ ID NO: 8203 - DNA, 390 bp, Homo sapiens
  ENST00000496049
gcttcgctctctgctcctcctgttcgacagtcagccgcatcttcttttgcgtcgccagccgagccacatcgctcagacaccatggggaaggtgaaggtcggagtcaacgggtgagttcgcgggtggctggggggccctgggctgcgaccgcccccgaaccgcgtctacgagccttgcgggctccgggtctttgcagtcgtatgggggcagggtagctgttccccgcaaggagagctcaaggtcagcgctcggacctggcggagccccgcacccaggctgtggcgccctgtgcagctccgcccttgcggcgccatctgcccggagcctccttcccctagtccccagaaacaggaggtccctactcccgcccgagatcccgacccggacccc

SEQ ID NO: 8204 - DNA, 1266 bp, Homo sapiens
  ENST00000396856
tgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagtgagtggaagacagaatggaagaaatgcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatg

SEQ ID NO: 8205 - DNA, 930 bp, Homo sapiens
  ENST00000492719
gttcgacagtcagccgcatcttcttttgcgtcgccagccgagccacatcgctcagacaccatggggaaggtgaaggtcggagtcaacgggtgagttcgcgggtggctggggggccctgggctgcgaccgcccccgaaccgcgtctacgagccttgcgggctccgggtctttgcagtcgtatgggggcagggtagctgttccccgcaaggagagctcaagatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctg

SEQ ID NO: 8206 - DNA, 1348 bp, Homo sapiens
  ENST00000396861
ttcgacagtcagccgcatcttcttttgcgtcgccaggtgaagacgggcggagagaaacccgggaggctagggacggcctgaaggcggcaggggcgggcgcaggccggatgtgttcgcgccgctgcgggccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccc

SEQ ID NO: 8207 - DNA, 1333 bp, Homo sapiens
  ENST00000474249
gtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagtgagtggaagacagaatggaagaaatgtgctttggggaggcaactaggatggtgtggctcccttgggtatatggtaaccttgtgtccctcaatatggtcctgtccccatctcccccccacccccataggcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggagg

SEQ ID NO: 8208 - DNA, 1363 bp, Homo sapiens
  ENST00000466588
aggcgtgtgtgtcggccggggccactaggcgctcactgttctctccctccgcgcagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagtgagtggaagacagaatggaagaaatgtgctttggggaggcaactaggatggtgtggctcccttgggtatatggtaaccttgtgtccctcaatatggtcctgtccccatctcccccccacccccataggcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggc

SEQ ID NO: 8209 - DNA, 1256 bp, Homo sapiens
  ENST00000396859
aggcgtgtgtgtcggccggggccactaggcgctcactgttctctccctccgcgcagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcat

SEQ ID NO: 8210 - DNA, 1720 bp, Homo sapiens
  ENST00000466525
ttctctccctccgcgcagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagtgagtggaagacagaatggaagaaatgtgctttggggaggcaactaggatggtgtggctcccttgggtatatggtaaccttgtgtccctcaatatggtcctgtccccatctcccccccacccccataggcgagatccctccaaaatcaagtggggcgatgctggcgctgagtacgtcgtggagtccactggcgtcttcaccaccatggagaaggctggggtgagtgcaggagggcccgcgggaggggaagctgactcagccctgcaaaggcaggacccgggttcataactgtctgcttctctgctgtaggctcatttgcaggggggagccaaaagggtcatcatctctgccccctctgctgatgcccccatgttcgtcatgggtgtgaaccatgagaagtatgacaacagcctcaagatcatcaggtgaggaaggcagggcccgtggagaagcggccagcctggcaccctatggacacgctcccctgacttgcgccccgctccctctttctttgcagcaatgcctcctgcaccaccaactgcttagcacccctggccaaggtcatccatgacaactttggtatcgtggaaggactcatggtatgagagctggggaatgggactgaggctcccacctttctcatccaagactggctcctccctgccggggctgcgtgcaaccctggggttgggggttctggggactggctttcccataatttcctttcaaggtggggagggaggtagaggggtgatgtggggagtacgctgcagggcctcactccttttgcagaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtc

SEQ ID NO: 8211 - DNA, 1292 bp, Homo sapiens
  ENST00000396858
tgcaaccgggaaggaaatgaatgggcagccgttaggaaagcctgccggtgactaaccctgcgctcctgcctcgatgggtggagtcgcgtgtggcggggaagtcaggtggagcgaggctagctggcccgatttctcctccgggtgatgcttttcctagattattctctgatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggg

SEQ ID NO: 8212 - DNA, 1086 bp, Homo sapiens
  ENST00000619601
atggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccagtt

SEQ ID NO: 8213 - DNA, 4161 bp, Homo sapiens
  ENST00000401533
cgcggcccggcggggctgccaggcggcgagcgccgcggcggccccgggaggtggcggcgggcgcgagagcctgggccgcgcgggactgaccgtcggggccccgggacggcggccccggggcgcccatgccatggagaagctggcggccgggctggccggcctgcgctggagcatgggcgccttcccgctcgacctcatcgtcagccgctgccgcctgcccacgctcgcctgccttgggccaggggagtacgccgagggcgtcagtgagcgagacatcctgctcatccactcctgccggcagtggacaacggtgacagctcataccctggaggagggccactatgtcatcgggcccaagatcgacatccccctgcagtacccagggaagttcaagctcctggaacaggcccgggatgtgcgggagccagtgaggtacttcagcagcgtggaggaggtggccagtgtcttccctgaccgcatcttcgtgatggaagccatcaccttcagcgtcaaggtggtgtcgggcgagttcagcgaggacagcgaggtgtacaacttcacgctgcatgcgggcgacgagctcactcttatgggccaggcggagatcctgtgcgccaagaccaccaaggagcgctcgcgcttcaccaccctcctgcgaaagctgggccgggccggggcgctggccggggtgggcggcggcggcccagcgagcgcgggggccgcgggaggcactggcggcgggggcgccaggccggtcaaaggcaagatgccctgcctcatctgcatgaaccaccgcaccaacgaaagcctgagcctgccctttcagtgccagggccgcttcagcactcgcagcccgctggagctgcagatgcaagagggcgagcacacggtgcgcgccatcatcgagcgcgtgaggctgccggtgaacgtgctggtgcccagccggccgccgcgcaacccctacgacctgcacccggtgcgggagggtcattgctacaagctggttagcatcatctccaagacggtggtgctggggctggcgctgcgccgcgagggcccggcgccgctgcacttcctgctgctcacggacacgccgcgcttcgcgctgccgcagggcctgctggccggggacccgcgcgtcgagcgcctggtgcgcgacagcgcctcctactgccgcgagcgcttcgaccccgacgagtactccacggccgtgcgcgaggcgccagcggagctcgccgaagactgcgccagcccgcgccgcgcgcgcctctgcctgcccgcgccgcgcgcccccgggctcgcccgcgcccccggcccgctagcgccggctcccgccggcgagggcgaccaggagtacgtgagccccgactgggcagccgcgcccgagcccgccgcgccgcccgccgagatcccctacgaggagttgtgggcgcaccaggggcccgagggcctcgtccggccgcccccagggctcgatctcatctccttcggggccgcgggaccgccgcgtcgggagccggaagcgccgccgcctccagtccctcccaaatccgaggcggtgaaggaggagtgccgcctgctcaatgcccctccagtgcctccccggggtggcaatggcagcggccggctctccagcagccccccggttccccctcgcttccccaagctgcagccggtacattcccccagctccagcctctcctactactcctctggcctccaggatggggcgggttcccgcagtggcagtggctccccatcgccggacacctactccctctattgctacccatgcacctggggagactgcaaggtgggcgagtcctctagccgcccagcccccggtcccctaccctcaaccacacagcccagccaggcctcccgggccctcacagagcctctgagcggtcgagccgcctcccttctgggggctgacacccctgttaagacctaccacagctgccctcctctattcaagccctcacatccccagaagcgctttgctccgtttggagctctcaaccctttttccgggcctgcctacccctcaggcccttcagcggccttgtcttctgggcccagaaccacctcgggtcctgtggctacctctggccctgcgtattccccaggcccagcctcgccaggccaggcctattcagctgctcccccctcctcctgcgccccctcctcctcctcttcttctgaatggcaggaaccagtcctggagcccttcgatccctttgagctggggcagggcagttctccagagcctgagctgctgcgttctcaggagcccagagcagtggggacacctgggcctggaccccgcctttcaccacttggcccctccaaggcctttgagcctgaaggtttggtgctgcaccaggtccccaccccactgtcaccagctgctctgcagggacccgaggcgggaggagcactttttctaacccaagggcgcctggaagggcctcctgccagtccccgggatggagccacaggctttggagtccgagatgcctcctcctggcagccccctgctgacctgtctgcactctccctggaggaggtctctcgcagtctgcgtttcatcgggctctcagaggatgtggtgagcttctttgcccgagaacgcatcgatggtagcatctttgtgcagctcagtgaggacatcctggcagatgacttccacctcaccaagctgcaggtcaagaagatcatgcagttcatcaaaggctggaggcccaagatctgaactgcccagctggagctgcacagctggaatgctggtatgggggccccaggtacagcactccggaggagcaggtgctgcctgcaagaaggatctatgtcgagactgaggctgctcagcagccactgggtggatccaggggagatgcatgtggaaatgtggtcctctggggtcagacccctgcacgggacatcttgcctttgagtgtgcagagtacatggggaaggggctgggggcaccactgtgtacctgggcccagtaaggcatttgccgtgattcccacaacggggtcaaaagctggccttcagggtgacctaacaccacctcatgccctgctatagaccttcacaaacgacttccactgctgaagcctgtaggctctgtttagagacaagaagatggctggtaatttaagcaccgatttcccaagtgcccactctcctttgtgctctgttggcttttggcctaaagctgccccagagtgagggtgtagatgtctgtgtctgtgagatgcctttcccttccccctctgctccaccgtggttgaggggggtggggcctggccccgcacacaggtgagtcgtgtacaagcctaacccatggcacctcagaggctccacctgtgggtcctggttcatgggtgacaactttggaagagcacagctctgcaattgacccgacccacttatctagttaggaagccagacactgcccagatgactctagcaccctggcttctgctctgactttactgcagctagtcatccatccgtcaggtggcgttcagtctcagaatactgattccgtggaagagcaggttgatttaggtcagcttctccttgattctagaagcaagcggtagtcaaccacctccaattccgccaatctcttgcccccatcatttgtctctgacaatacttggtgtttttccctggttttctgtcactggcacaggagggtacagttgggagagtgcgttcctggagctcagtcctgcatttgttcacgtgcctcacagcaggcctttgtgcccttgaatctcaaacatggggatctgcttggtacccagagctctggtcattgtgtccaaccacacaccccaccccatccgtgtcctccatctcacccagaaccacagggtgcccactagtgtcagggcccaaagtgccagccttctcttctgccttacctagtctacctatttatttcctccactttttatcttaaaagtagctaagccatgctggtgcccatactccaagcaggctgcctcagctcagagaagtggtcagagagtagagcacagaacctgtgatgtggggacatttggttttcttgcagatcatttaatgaatcctcaaggactaatgaaataaatgctagactgctgaagatgagtacaagtggca

SEQ ID NO: 8214 - DNA, 5138 bp, Homo sapiens
  ENST00000407684
aagcgattcccctgcctcagcctcccaagtagctgggactacaggtgtgtgccaccacacccagagagttttttgtatttttagtagagatggggtttcaccatgttggccaggctggtctcaaactgctgacctcaagtgatctgcccactttggcctcccaaagtgctgggttacaagcgtgagccaccgtgcctggcctgccatctccatttctgaccaggctggtggcctgagtacatcatcctgagtcccttccttccccacctcccccttcttctgtcacccaagcctgctgggtctcccttcccagtatctcttggtctgtttctgctattccctagctcttctccagaaccccttactggtttgtttacctgactggtctcccggttattttaatagagctgaacctggatcatggtatttctttgctcgaaacactccagtgggtctcatgttgtacagaataaagctttactgctttagcaaggcattcagagcctttcaaatcccagttgctgtctgcatcccctcctgtcctccctctccctaagtccttccctgcaggcacgcaccatctggggcaggtggtctgcttttgtgtctctgtgtctgtgtttacagtgtttcttccacagggaatgcccattctgtgaattccctttgattcttaaggtgcagctcagtgatcctctcagattccgccaggcaggttttgcctacctagccgtcttgtaactcttttgtcacaagtctgttgtagcacttatcacatcctgccaccattgggtactcatcgtctcacccattatatctggatttctttaagggcagactgtattttacacagatttgtaccctctgtgtggcctaccatagtgtctgacacatagtgagtgctccatcaatatctgtgcaataattaaatgaatgaactgtgacagaagcaactaccacaggggcttcagaagctaaagaaggcccagcgcggtggctcacacctgtaatcccagcactttgggaggccatagcaggaggattgctcgagcccaggagtttgagaccagcctgggcaacatcatgagacgtcatctctaataaaaataaaaaattagccaggcatggtggcacatgcctgtggtcccaggtacttgagaggctgaggcaggaggatcccttgagcccagaaggttgaagctgcagtgagttgtgatcatgccactgtactccagcctgggcgacagcaagaccctgtctcaaaaaaaacacccagaggctaaagagtcaccttgtcttctctcgacttgttccctcacctattcatggctctcttcctactgtataaagcttgagaagaggccatccatcagatgccagggcggctcagagcttgttttgtgctcatgtgggtatgcatataacaggtgtctggccagtgaggtgagagagcttacacagggatgtcagcttcacagactggcaatcacttccgtaaagtctgtgtctcctaggggcatgtgctgagcttggcaaagcacgcagccccagactgcaggttgggaaggcctactctcagggaggtggctttgctgggttcaggtcagagcctctgggagagtaggattggatattggaccagggcagggtgtgggaacagagctggggtcagagtggttctcccagggccttcaagggctgggccaggccctggttggcccagtgccacctccatgcggatcagcagcccagggcgatgcacaggatgccagatccagggaagttcaagctcctggaacaggcccgggatgtgcgggagccagtgaggtacttcagcagcgtggaggaggtggccagtgtcttccctgaccgcatcttcgtgatggaagccatcaccttcagcgtcaaggtggtgtcgggcgagttcagcgaggacagcgaggtgtacaacttcacgctgcatgcgggcgacgagctcactcttatgggccaggcggagatcctgtgcgccaagaccaccaaggagcgctcgcgcttcaccaccctcctgcgaaagctgggccgggccggggcgctggccggggtgggcggcggcggcccagcgagcgcgggggccgcgggaggcactggcggcgggggcgccaggccggtcaaaggcaagatgccctgcctcatctgcatgaaccaccgcaccaacgaaagcctgagcctgccctttcagtgccagggccgcttcagcactcgcagcccgctggagctgcagatgcaagagggcgagcacacggtgcgcgccatcatcgagcgcgtgaggctgccggtgaacgtgctggtgcccagccggccgccgcgcaacccctacgacctgcacccggtgcgggagggtcattgctacaagctggttagcatcatctccaagacggtggtgctggggctggcgctgcgccgcgagggcccggcgccgctgcacttcctgctgctcacggacacgccgcgcttcgcgctgccgcagggcctgctggccggggacccgcgcgtcgagcgcctggtgcgcgacagcgcctcctactgccgcgagcgcttcgaccccgacgagtactccacggccgtgcgcgaggcgccagcggagctcgccgaagactgcgccagcccgcgccgcgcgcgcctctgcctgcccgcgccgcgcgcccccgggctcgcccgcgcccccggcccgctagcgccggctcccgccggcgagggcgaccaggagtacgtgagccccgactgggcagccgcgcccgagcccgccgcgccgcccgccgagatcccctacgaggagttgtgggcgcaccaggggcccgagggcctcgtccggccgcccccagggctcgatctcatctccttcggggccgcgggaccgccgcgtcgggagccggaagcgccgccgcctccagtccctcccaaatccgaggcggtgaaggaggagtgccgcctgctcaatgcccctccagtgcctccccggggtggcaatggcagcggccggctctccagcagccccccggttccccctcgcttccccaagctgcagccggtacattcccccagctccagcctctcctactactcctctggcctccaggatggggcgggttcccgcagtggcagtggctccccatcgccggacacctactccctctattgctacccatgcacctggggagactgcaaggaaccagtcctggagcccttcgatccctttgagctggggcagggcagttctccagagcctgagctgctgcgttctcaggagcccagagcagtggggacacctgggcctggaccccgcctttcaccacttggcccctccaaggcctttgagcctgaaggtttggtgctgcaccaggtccccaccccactgtcaccagctgctctgcagggacccgaggcgggaggagcactttttctaacccaagggcgcctggaagggcctcctgccagtccccgggatggagccacaggctttggagtccgagatgcctcctcctggcagccccctgctgacctgtctgcactctccctggaggaggtctctcgcagtctgcgtttcatcgggctctcagaggatgtggtgagcttctttgcccgagaacgcatcgatggtagcatctttgtgcagctcagtgaggacatcctggcagatgacttccacctcaccaagctgcaggtcaagaagatcatgcagttcatcaaaggctggaggcccaagatctgaactgcccagctggagctgcacagctggaatgctggtatgggggccccaggtacagcactccggaggagcaggtgctgcctgcaagaaggatctatgtcgagactgaggctgctcagcagccactgggtggatccaggggagatgcatgtggaaatgtggtcctctggggtcagacccctgcacgggacatcttgcctttgagtgtgcagagtacatggggaaggggctgggggcaccactgtgtacctgggcccagtaaggcatttgccgtgattcccacaacggggtcaaaagctggccttcagggtgacctaacaccacctcatgccctgctatagaccttcacaaacgacttccactgctgaagcctgtaggctctgtttagagacaagaagatggctggtaatttaagcaccgatttcccaagtgcccactctcctttgtgctctgttggcttttggcctaaagctgccccagagtgagggtgtagatgtctgtgtctgtgagatgcctttcccttccccctctgctccaccgtggttgaggggggtggggcctggccccgcacacaggtgagtcgtgtacaagcctaacccatggcacctcagaggctccacctgtgggtcctggttcatgggtgacaactttggaagagcacagctctgcaattgacccgacccacttatctagttaggaagccagacactgcccagatgactctagcaccctggcttctgctctgactttactgcagctagtcatccatccgtcaggtggcgttcagtctcagaatactgattccgtggaagagcaggttgatttaggtcagcttctccttgattctagaagcaagcggtagtcaaccacctccaattccgccaatctcttgcccccatcatttgtctctgacaatacttggtgtttttccctggttttctgtcactggcacaggagggtacagttgggagagtgcgttcctggagctcagtcctgcatttgttcacgtgcctcacagcaggcctttgtgcccttgaatctcaaacatggggatctgcttggtacccagagctctggtcattgtgtccaaccacacaccccaccccatccgtgtcctccatctcacccagaaccacagggtgcccactagtgtcagggcccaaagtgccagccttctcttctgccttacctagtctacctatttatttcctccactttttatcttaaaagtagctaagccatgctggtgcccatactccaagcaggctgcctcagctcagagaagtggtcagagagtagagcacagaacctgtgatgtggggacatttggttttcttgcagatcatttaatgaatcctcaaggactaatgaaataaatgctagactgctg

SEQ ID NO: 8215 - DNA, 273 bp, Homo sapiens
  ENST00000496070
gagccggaagcgccgccgcctccagtccctcccaaatccgaggcgggcgggttcccgcagtggcagtggctccccatcgccggacacctactccctctattgctacccatgcacctggggagactgcaaggtgggcgagtcctctagccgcccagcccccggtcccctaccctcaaccacacagcccagccaggcctcccgggccctcacagagcctctgagcggtcgagccgcctcccttctgggggctgacacccctgttaagacctacca

SEQ ID NO: 8216 - DNA, 905 bp, Homo sapiens
  ENST00000439286
tacctcccccttgatgggtggcgggatcccggagccaacgcagaccggacgtcggaacgccgctttagccccgggacagctgcccagcctccaggcccactgatggacccgttaacgaaggtgccttgtgggagtcagatagcacaaaccattctatggaaagcaaagtcgtctctctccttcggcatccagccccttcagacatggccaacgaaagaccctgaactagagtcccaggtcaacctctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaaggg

SEQ ID NO: 8217 - DNA, 667 bp, Homo sapiens
  ENST00000444677
agagcagaactgagcaggcggtggagctgggtctggtccgggcacggagtgggggcttcgaagggaaaaggcggggctcctgggggcggagccatacctgtgggcgggacatgggaaaggagggcccgaggggcggagctacaatagaaagggccaggaggtgctgaggcgaggagaggccgaactccaagggacgacgctcgcggaagcagaggtttggggacagctgcccagcctccaggcccactgatggacccgttaacgaaggtgccttgtgggagtcagatagcacaaaccattctatggaaagcaaagtcgtctctctccttcggcatccagccccttcagacatggccaacgaaagaccctgaactagagtcccaggtcaacctctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccg

SEQ ID NO: 8218 - DNA, 694 bp, Homo sapiens
  ENST00000429629
aggcggggctcctgggggcggagccatacctgtgggcgggacatgggaaaggagggcccgaggggcggagctacaatagaaagggccaggaggtgctgaggacagctgcccagcctccaggcccactgatggacccgttaacgaaggtgccttgtgggagtcagatagcacaaaccattctatggaaagcaaagtcgtctctctccttcggcatccagccccttcagacatggccaacgaaagaccctgaactagagtcccaggtcaacctcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaag

SEQ ID NO: 8219 - DNA, 536 bp, Homo sapiens
  ENST00000453030
aggaggtgctgaggcgaggagaggccgaactccaagggacgacgctcgcggaagcagaggtttggggacagctgcccagcctccaggcccactgatggacccgttaacgaaggtgccttgtgggagtcagatagcacaaaccattctatggaaagcaaagtcgtctctctccttcggcatccagccccttcagacatggccaacgaaagaccctgaactagagtcccaggtcaacctgtaacttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacag

SEQ ID NO: 8220 - DNA, 523 bp, Homo sapiens
  ENST00000446764
gcgcgagccgagcggccggccgaggcccgagcccacccgagtgcgcccgagcccgcggcccccgcccggggcgatggaaccggagcccggcggggtggccgctgcgctcctgcggcagaagagggcggcgctgcggcgcagggggtgcagcttcgagagcccaaggacagctgcccagcctccaggcccactgatggacccgttaacgaaggtgccttgtgggagtcagatagcacaaaccattctatggaaagcaaagtcgtctctctccttcggcatccagccccttcagacatggccaacgaaagaccctgaactagagtcccaggtcaacctctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtg

SEQ ID NO: 8221 - DNA, 653 bp, Homo sapiens
  ENST00000441134
agaagagggcggcgctgcggcgcagggggtgcagcttcgagagcccaaggacagctgcccagcctccaggcccactgatggacccgttaacgaaggtgccttgtgggagtcagatagcacaaaccattctatggaaagcaaagtcgtctctctccttcggcatccagccccttcagacatggccaacgaaagaccctgaactagagtcccaggtcaacctgtaactctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaag

SEQ ID NO: 8222 - DNA, 577 bp, Homo sapiens
  ENST00000478702
gattggcggccggagggatggcaaagctgccacgcgcacgggggtgcaggctgcgggactgcgatcgctgccggataggaccagctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaag

SEQ ID NO: 8223 - DNA, 831 bp, Homo sapiens
  ENST00000425970
actagaagcaagaatgtagcctgggtaatatctggaacactttcaaactgcatgcattgatgtgttgcccattttcagctaagagagggaggactacaaaaggttaaatttctcatataagattaattcagccatctctgtgaaatggtggaagcagaatgccattagactctctaatctcatttctctcatgctgtctttcttggagcctgtcaaacagtgtcctggcagagagtcagttctctggttgctaaacatcagagtcagtctctttctgcatgtgccaagagggctgtaatttagaaaatgcaacctaccttttaaggaaggatgaaaagctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaag

SEQ ID NO: 8224 - DNA, 578 bp, Homo sapiens
  ENST00000498801
attcaggatgaaaacgtagtaacaattttgcccttgttttaattactcttcaacaacatgtgatttttgaaatctgatttaagcctttttgggggctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctga

SEQ ID NO: 8225 - DNA, 554 bp, Homo sapiens
  ENST00000487565
atttttatgttgcatatttgggacaaagagctctcttaaatgaaagataattgcaagatccggttcagcagctttgtcccttgcctcaagtttactgcagggcttctctcctctctggttatacagaaatgaaattataaaccaccagtaaccttggaaatttcaatcgattccaaatgactaaatatttaattgaatcattgcctatacttccagggatgactctggcgtttgctttttattgagggctccatgaaagccaggctctgcaatggctgctggggactgtgtctgttgcaaggaggctcccctgcagtgaggagccggggcactgcaagtctgttccatagcagccctttttgcaaatgctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgt

SEQ ID NO: 8226 - DNA, 3800 bp, Homo sapiens
  ENST00000373387
atatttgggacaaagagctctcttaaatgaaagataattgcaagatccggttcagcagctttgtcccttgcctcaagtttactgcagggcttctctcctctctggttatacagaaatgaaattataaaccaccagtaaccttggaaatttcaatcgattccaaatgactaaatatttaattgaatcattgcctatacttccagggatgactctggcgtttgctttttattgagggctccatgaaagccaggctctgcaatggctgctggggactgtgtctgttgcaaggaggctcccctgcagtgaggagccggggcactgcaagtctgttccatagcagccctttttgcaaatggtagttgatttttgcagaaggtttgtggccagatcgctatgtataatactgatgaagcatttttgttccagctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccaggtcggatatatacttcacagcaactgcagctgtgaatgaggtctcatctggaggcagctccaagggggccagtgcccgaaattctcctcagacacccccgggccgagatactccagtatttccttcttccctgggggaaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattcttatttactgcaaccttctcatattttatatacttagatggaaaattattttttcattacagttttgatttatgtcacataatgtgtttcttttataaagaaaagtcgttgctttttaacttta

SEQ ID NO: 8227 - DNA, 3143 bp, Homo sapiens
  ENST00000373386
ataatactgatgaagcatttttgttccagctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccagggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattctta

SEQ ID NO: 8228 - DNA, 549 bp, Homo sapiens
  ENST00000464616
attatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggctgaaaatattttcagaagagagcgtaccactctttggccctcccttgccaactccaccagtgtttacagaccaccaggaattcagggactttttgctagtgaaa

SEQ ID NO: 8229 - DNA, 737 bp, Homo sapiens
  ENST00000495172
agggctggacaccacctgcagtgtcctctaccatctgtggctggcaggatcagttgcattctcactgttctaaacctttcttttccagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccg

SEQ ID NO: 8230 - DNA, 569 bp, Homo sapiens
  ENST00000460176
tgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctg

SEQ ID NO: 8231 - DNA, 639 bp, Homo sapiens
  ENST00000481875
ggtacaaccctagtaaaaattggtattgagagatgttgctttttctttgatgaacaaaaatagcgttttcatgcctctgctgctacgccccctatatagagttcgggatatagaattgcctatgggaagaaagcatcagtacttcttcctgagctaggaggagaatagtgcttgaatgtattttgtagagcttatgaaagccctagaagctgacttccttccttgcctagagataacttgggttcaaaactacccacaggcacgtttggtgggttctggaaagcgtgggctgggttgcagtgatgggtaaccaggtttccttttccagatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacac

SEQ ID NO: 8232 - DNA, 488 bp, Homo sapiens
  ENST00000478696
tatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactcttcccagcagcaagcaccagccttccacggcaacacggtatcttcgtgcagctttcctgtttacactactgcttttttattaaatggtgttcagtt

SEQ ID NO: 8233 - DNA, 1859 bp, Homo sapiens
  ENST00000496711
attcggaataaactgcttctgatcacaagaaaacacaacaagccaagcggggtcaccagcacctcattgttatctcccctgtctgagtcacctgttgaagaattccagtacatcaggactagggtacattaaggtatggaatatatctagcattggccactaagatggagtatttctactggagagctgagaaggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacaggcagggtcagtgttctcatgatgcctgctttacagacgaagacctaaggccagaggctaagccatttgccacacaccacagaggcaaaactgaggcccagagagaggagtttgccccagaccacggaactaggtgttctgacacccttttcattgcaccatgctgcctctcttgacatgaagaacagagaaagaataaagtgtgaagacatgccgtggcgattttaaggtgcacagactttatctgttggaggcagaaggatgcctcgctggaggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccaggtcggatatatacttcacagcaactgcagctgtgaatgaggtctcatctggaggcagctccaagggggccagtgcccgaaattctcctcagacacccccgggccgagatactccagtatttccttcttccctgggggaaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattctta

SEQ ID NO: 8234 - DNA, 4816 bp, Homo sapiens
  ENST00000481242
attgccacgtctgtctgcctgtcagcacagcgttggagccccttggtagacttacttgatgccaagtacccccctggtgtctgtggtcattgtgcatagatcttggtctaaaaggctgcctgaacttcctccatacgtgtcaccactgccaccctccctcaccccaccccaaacacacacacaggccttatctctaaactaaaagcctgtctagttccacctttcccactgcagtcaaccctcccataattataataattgtggccatcactgaatggccacctctgtgtaccaggccctgggtcagagcatgtcataagcgttatgtcttggaaggggctcttcatttctccttttttttttttttttttttgagacagagtttcgctcttgtaccccaggctggagtgcaaggcacgatcttggctcactgcaacctccacctcccaggttcaagcgattctcctgcctcagcctcccaagtaactgggattaggtgcccaccaccacacccgactaatttttttttttttttgtatttttagtagagacagggttttgccatgctagccaggcttgtcctgaactcctgacttcaggcccacctcggcctcccaaagtgctgggattacaggcatgagccaccatgcctggcacatttctccatttttattgaaaaggatactgaagtcagaaagaagaagtcacttacttaccccagagcacacagctagtaagtggcagaggcaggacttggaccccagctggctgactccagagaccatgttcccacagctggtggggatagcaggtccagccacaaagctggtagcactcggcccctcccgtggagaagctcccagtctggcagagcagacacggtgcagcacaaagcctctagctgagatagtgaagtaaaactaacatgtacagggacatctgaggaggaagggattttaagtcaaagtggtggggccaggaaggctcctttctggggtcagaggagactccaggaccatccttcatgtaatatacccattggtgctggttccttatctaaataaaggtatcagccaacattgagcatttaccgagctccaggccctgtgctaggtgcttagataagttacctcctggagtcctcaagccagtaggcctagatactcttattttctaccatcttacaaacgaagaaactgaaggtccgagaggggaaacaactggcgtgagtgcgcatgcctctgaagtgatggagctgggatttcatttactcacttgcccatccgatgagtttattctatccctgccacccgccaggccctgatctggatgatgaggggccagcagtgagcagcacagacaggcctttgcgtcatgagccttagatctcatggggaggggagccacagggaacaaacagacaagagagcaccagagggtgagggacactctgcagagagcctaaaacacagggcatgataggagccatggggattattttggatttgacaacccccgggtctgtccaatgccagtgctggagctcttggccactggtcctcactgtcactccctgctgagctcctgcaacttttggttgaggcatttgccccattataccttgttttatgtacttatgtgcttttctggttttttttcttaaggggtcaacctcaccttattcttttctgtatcctagtggcactgaatacagtgctagataatgacagatgggagagagctggggattccattggaaggggcacccaagcccaggcagtggcactggctgaggatggccagttggggccttggcaccataatgagaccttttagaggtgaaggctgtgttctggtgacaccagtgaagagaagggtcagccagtgcagggccagtgggaggagcacagtgtggacggaagggctgggacagaggagccagcaggagcccacaacatggtgctcctgtgaggaggtcagggcttagcctagaacagcagcaggggcacaaaaaaacacctgagaaactgtatgaagaggctgctgctggacttgggttggaggtggccctgagactttgagaatagttatgctaacaaaaaggaggagttttagaaggaaagctggttgtgtgggagataaaaagccaatagccttcactgagtgctcatcatgcatgaggccctgtgctaaaatctctgccttgtctcactgaattcccattacaatccagcagggtcagtgttctcatgatgcctgctttacagacgaagacctaaggccagaggctaagccatttgccacacaccacagaggcagtaagtggcctagacagggcttgatctcccatctgtctgcccagtctgtgcccctccaaccaccccacccccaatccactacctcctgcttttaatgacttggatgtggaatcagttacatctgagaacaaacgacatagtctaggggctgcagccctggggagaatgtgtgcctgagcccgtgaatttagggttttgggcacaaagcaaaatttggagctatagaagtggggttttactaaggagagaagagccaagaaattgaagaataatctgaggtgggagagagggcaggaggcagaagatgtcacccatcagaggctgcagagggcaggatggatagatgagcagaggccaaggccttcggttggggagaaggagatcttggctgagctcaaagggtggttttcctggaagcacaggaggccaggctctaagggttgagaatacaagtgaggaagtgaaaggagcaggaggctcttagagggctggagttttgaaaatcaagaaggaccaaggacaccatcaggttgagtgccctcctctcaaatgcagaaactgaggcccagagagaggagtttgccccagaccacggaactaggtgttctgacacccttttcattgcaccatgctgcctctcttgacatgaagaacagagaaagaataaagtgtgaagacatgccgtggcgattttaaggtgcacagactttatctgttggaggcagaaggatgcctcgctggaggtacgagagcggtaaggttgaaagagaaccagaacattagttcagatgttggctgtggcgtgtaccagtcaagggacttaagtgacttcaccctgagcctcactttcatcttctgtaaaatgataattataccataatgtcaataatattaggttgatgcaaaagtaattgcagtttttgccattggaaataatggcatataaacctgaggcatttcaatagagagaggagacataccaaacacagagcttctcaacggctatgaaaagatgatgagaaagtcccagagaagaaagaatggagagacttttctttcttttttttcttttcttttctttctcacttccattgtattataatcccagcccccaatgtgcattgtgggtgctggtggggcagacatgaccctatggcacctgcatgacagagggcctcggcctccacaaatgctcacaacttgtaaaagtcttttcacagggtcagcatccagcctgcccactaccgttgcccgttatcattgcaggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccaggtcggatatatacttcacagcaactgcagctgtgaatgaggtctcatctggaggcagctccaagggggccagtgcccgaaattctcctcagacacccccgggccgagatactccagtatttccttcttccctgggggaaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattctt

SEQ ID NO: 8235 - DNA, 304 bp, Homo sapiens
  ENST00000497703
gggccagtggatgcaaggcctagaacaccaggcagcccggtaatgctctctcttcctttctagtcggatatatacttcacagcaactgcagctgtgaatgaggtctcatctggaggcagctccaagggggccagtgcccgaaattctcctcagacacccccgggccgagatactccagtatttccttcttccctgggggaaggtgaaattcaatcaaaaaatctgtacaagattccacttagaaacctcgtgggcagaagcatcgaacgacctctgaagtcacccttagtctccaaggtcatca

SEQ ID NO: 8236 - DNA, 887 bp, Homo sapiens
  ENST00000463005
aacagtagtgggttttgaaagctaaaagaatagagtcatcaagcctagacattccccagcacatgcagtctttcactctatctggctttgcccgcaaaccccagaggcctctgctgtggttacctcatcgctttgaacacagcgcttttcataaattcttaccacatcactcatctttattgcacgcagttaagataaagcacagaattccccaagcagggcagctttttgcttttcttgtctagtcttttttcctgtgcagtcacgagtgcattttacctaatttacacatgaaaatgctcttagaaaacgcaaagccatcaggcaccctcaaatcagtgctcctggccagccctcccagtgggacattacagatcagtgtgtgacataacgtcttccttcatgctatgttaaggaacaagaaattactctcttgtaaataatgtgcacttttcttaaagttctgatgttctttttgaaatcacatttcaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgag

SEQ ID NO: 8237 - DNA, 3599 bp, Homo sapiens
  ENST00000435213
actagaagcaagaatgtagcctgggtaatatctggaacactttcaaactgcatgcattgatgtgttgcccattttcagctaagagagggaggactacaaaaggttaaatttctcatataagattaattcagccatctctgtgaaatggtggaagcagaatgccattagactctctaatctcatttctctcatgctgtctttcttggagcctgtcaaacagtgtcctggcagagagtcagttctctggttgctaaacatcagagtcagtctctttctgcatgtgccaagagggctgtaatttagaaaatgcaacctaccttttaaggaaggatgaaaagctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccaggtcggatatatacttcacagcaactgcagctgtgaatgaggtctcatctggaggcagctccaagggggccagtgcccgaaattctcctcagacacccccgggccgagatactccagtatttccttcttccctgggggaaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattcttatttactgc

SEQ ID NO: 8238 - DNA, 2827 bp, Homo sapiens
  ENST00000298743
agcagccggcacggggacagccggccgcacaacggatctgcaggcgcggagcaaaatgcacccgccgcgccgcgcggtcctgcagccccgccacggccccgcggcccgcacccccccggggcgacagtgagcctctcccgccaccaccgggggccgagcggagggctctcgggtgggagagcgggaccagatctcgacagctgttcatttccaggaagccaccgcagccagagcgaaaggggaccttctgccaccagcggggcatcagccagcggcgcgcatggatttatgaagacactcatgcaagaagtgggcaggacttggacaaacttttccaccggctccgcgtccgccgctccccgcgcctcgtctcctttcccctcctctcccggcggccgccgctgcccgcgatggtggccgcgctgctgggcggcggcggcgaggcccgcggggggacagtgccgggcgcctggctgtgcctgatggcgctgctgcagctgctgggctcggcgccgcggggatcggggctggcgcacggccgccgcctcatctgctggcaggcgctgctgcagtgccagggggagccggagtgcagctacgcctacaaccagtacgccgaggcgtgcgcgccggtgctggcgcagcacggcgggggcgacgcgcccggggccgccgccgccgctttcccggcctcggccgcctctttctcgtcgcgctggcgctgcccgagtcactgcatctcggccctcattcagctcaaccacacgcgccgcgggcccgccctggaggactgtgactgcgcgcaggacgagaactgcaagtccaccaagcgcgccattgagccgtgcctgccccggacgagcggcggcggcgcgggcggccccggcgcgggcggggtcatgggctgcaccgaggcccggcggcgctgcgaccgcgacagccgctgcaacctggcgctgagccgctacctgacctactgcggcaaagtcttcaacgggctgcgctgcacggacgaatgccgcaccgtcattgaggacatgctggctatgcccaaggcggcgctgctcaacgactgcgtgtgcgacggcctcgagcggcccatctgcgagtcggtcaaggagaacatggcccgcctgtgcttcggcgccgagctgggcaacggccccggcagcagcggctcggacgggggcctggacgactactacgatgaggactacgatgacgagcagcgcaccgggggcgcgggtggtgagcagccgctggacgacgacgacggcgtcccgcacccaccgcgcccgggcagcggcgctgctgcatcgggcggccgcggggacctgccctatgggcctgggcgcaggagcagcggcggcggcggccgcttggcgccccggggcgcctggaccccactcgcctccatcttgctgctgctgcttgggccgctcttttagccctcgcgccccccgccgttggctgcgggagagcccgcgtcccactcccgtgctcgcctcgaccccgcgccgggcacctgtggcttgggacagatagaagggatggttggggatacttcccaaaactttttccaagtcaacttggtgtagccggttccccggccacgactctgggcacttcccctgaagctcctctccggagcttgacttcttggacctcctcccccgccccaattccaagctccagaaactcccaactcgtctgccgtccagaaagctagctgcagtgttcaggacgtccgggaggaagcaagcatgtgggggacagaacagtagtcctggactcgaaagggaaggtgctgaccagtggggccttagcaatttgaagggttgggaaggaggaattatatttgcaaaggggctgtctattagcatatttcctttgagggggcaaaaaaaagtgccagtatcgacttttacagattgtggccagtgaggatattataatcctatgtaaacagaaaagtcccacttaccgattcattctttcactgtttgtatctgcgcccagaattctcagtgacgtgggggtgagggtgggtggcgattgccttagagggaacccctaaattggttttggataagtttgagcccttgaccttaatttcattgctaccactctgatctcttagcacatttcttaggattaagggtccaaaaatgctgatctaaggggttgccatggtgttgaacaatgcaactttttatttaaaaaagctctgcactgccatgtatgaaagtctctttatgatgtttgtttttttgtcatttttgttctttacatcaagaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgttttttaaaaatcctaagtttttaaataactatggatttgtgtattttttttggttatttgttttattaaaacatgtacatcagtaaagagttttaaacaatga

SEQ ID NO: 8239 - DNA, 2597 bp, Homo sapiens
  ENST00000396659
aacgggccttcttgcgacgctcgggtctgggtccgggtccggacgtgcaacagaagccgtcagtggccccgctggctaaaaaagggcaagcatcggaggctcgagccagcggccgcggcgcttcccgacagttcctaattcggggcgctacgccggccccaccacctgttcccggcagccaatggggccgcggggggcggccggggcggagcgcggctacaaaaggcctcgggccccgcgcgcccgcccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgataccgtatgtgtatttttattctaataaacttttgtgttccagattgaa

SEQ ID NO: 8240 - DNA, 3911 bp, Homo sapiens
  ENST00000558362
accccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcgggtgcgtgcgccaccggcctcgtctggcggccgcgtgactcactcgatcctgcgggcggcgtggagcactcgctcgctccctgcccggagccgccaccttccctcgctttccctagccggaattgcacgagagtgtcccttctggtatccctgggaagctcagcttcaagagccttcgcaggctccaggagctgggcggcgtcccccagtcagggggaacttgcgttgcggctccagcccttggggtccacttgctgtctgcgcgtccgcggcctgctggcccacggcgcagggggcgccgcccccctctaccggaccttggtgcgctgcaccaagcttcccgctcggagcaaggggttgggacgacggaggctcctcttagtaaaagggtggcgttattggggttcagtagcctgagtgggcgtcgagttggggagatttctggaaaatgcgtgtggggtagatggatggggagaagaggcaagcaaagtgggaatcggggacggggagcgagcgaccagattcactccaagtataacatgggatcccacgtctggagaggagtcggggcgagtgcagcctgtaagcagagtttctgcgctccccgccctcggctgccctggcagcagaccctcccatgcttctagtactggaatcgctccgacattctggcttcctcccagcaactggttcctgaacagctgtcattctccgtctttcttctgcctccacccgagttctcctcctgcccacttcctaaggcttttaacagagcaggatagagatttggggggttgaggtttgctcaggggttgagggaccctccctgctctagattttataggccatgcatttttaaaaggcttttgaagtttttagatctccttcttatttgtttgaatttacgcctgagctaatcctgaccttggctagggtactgtggaccatctgtaaaatggagcagatggcagttgctcactctcagaattgaagtgccaaagaatgcgaagtgtatgtcaaagatgaaaaaaatttgatttgaagctggttattctgaaagataaggtcctttacaaatgttcccaacttttcatttgtaaaaaaaaataaataaaaagcctaatattggtaacctttgatacttaagggaaaaggaggttccgtccccagctgagactggcgggaagttttagagcagctgtctatggttttctgagaggaggactgacccatctgcaaaacagttgcttaaagcttgagtgcaggaattgcattctgagataaagatgggggtgtatggtagctggggacacggtcttctgaggagttttaaagagttacagcaattaatagataagaagacaatttgtagataaacaagagggttaaaaaaattatctgtaatcccactacccacctacacactgttaacgtcttggtttatgctgttctaaaggggtttaagtggcaatgttatgctggatttttactccatctccacttcctcctctctgtaagtactgatagagcaatgcaatacaataatcttttctttgttcttggaagcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgataccgtatgtgtatttttattctaataaacttttgtgttccagattg

SEQ ID NO: 8241 - DNA, 1522 bp, Homo sapiens
  ENST00000558336
cccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatgtacaacaaatgaaacatgttgtcatacatgaaaacgttaaatgagaagaactaaagaaatgacatgctaggtttgataaatggtttgtctaattcaattttgattccttttagaggcaccaagttattatttcacagaaagtcagtatttttattttcaacacacgtagccccaacaagttggagatgcatcctgagctcctgagacatccccttaacaataagtttataaatcttatatgacttagccaacgttttggtgccc

SEQ ID NO: 8242 - DNA, 562 bp, Homo sapiens
  ENST00000561376
caaccctgaccgaccatgtcaccagattgatcttttcaagaaagcaggatggactatcattactcctccaacaccaatcatcccagacggtatgtttactttcatacactgttagactaaaataattactttagtgaccaaggatctttctcctatagagagcagcccaaatgttagcagcttagagaatgtgtttcctcagtaaggtgtgaagtggtgcttgggactgtgagcatcagaacaaggctgggacttgtgtttgcaactttttcatccatagaaaatgaagtaaggagaagacagaataaaacaacatcacgtaaagcaagatatgactttttttttttttttgagacagtgtcttgctttgtcacccaggcttgagtgcagttgtgcagtcacagctcactgcagcctcaagactcctgggctcaagtgatctttccactccagcttcctaagtagctgggactacaaatgcaggccactatgcccagcaagttatttttttttatttgtagagatgatgtcttgctgtgttccccagtgaggcaccatctct

SEQ ID NO: 8243 - DNA, 913 bp, Homo sapiens
  ENST00000558916
attcaacagatactgagtgtctgcccagagggcttatgtgctcaatgctagggatcagcactgaacatggagtggttggagtctcaattccaataccttatacaaagagctgtttactgcctatgaacctatcatgagctgtatttttctcctgtaagtattgtgtttatttgcttctacttccaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcatta

SEQ ID NO: 8244 - DNA, 569 bp, Homo sapiens
  ENST00000558163
aaggcttggaccgacgcggcccagaggccaggaacattccgcgcgtggaccagccgggccagggcgatgctgcgggtgcggtgtctgcgcggcgggagccgcggcgccgaggcggtgcactacatcggatctcgggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctca

SEQ ID NO: 8245 - DNA, 493 bp, Homo sapiens
  ENST00000558537
accggaccttggtgcgctgcaccaagcttcccgctcggagcaaggggttgggacgacggaggctcctcttagtaaaaggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacg

SEQ ID NO: 8246 - DNA, 903 bp, Homo sapiens
  ENST00000561148
aaatcgagttgcctaacccagagctttcccgagatggtcttcgttacaggtgtctgggaggcggcttaagctcacttcactaggtcattaagcatgtactttggtggttacatatatcttggaagtcaccggctttacattctgttttcctggccttcgaactggagcatcagtactaccgccgttggaatagcaacctagagactttgctattttgtgaagaaactctaactatccgcatgggcacagaattttgggtgctctggtgcaaatgtctcagttctggaggctgggaagtcaaagacaaggcactggcagattccatgactggaaaggagagaaggtctctgaggaagtgacattccagctgagacgtgaaggataagtagaaaccaagcagaagaattggaagaggaaagggaagagggaaaagcctgtgccaatgccctgagattggaatatgctttttgtgtttaagaaattaacagaagcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtcta

SEQ ID NO: 8247 - DNA, 579 bp, Homo sapiens
  ENST00000559885
tagataagaagacaatttgtagataaacaagagggttaaaaaaattatctgtaatcccactacccacctacacactgttaacgtcttggtttatgctgttctaaaggggtttaagtggcaatgttatgctggatttttactccatctccacttcctcctctctgtaagtactgatagagcaatgcaatacaataatcttttctttgttcttggaagcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcct

SEQ ID NO: 8248 - DNA, 554 bp, Homo sapiens
  ENST00000558118
attccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaagtagagacggggtttcaccgtgttagccaggatggtctcgatctcctgacctcgtgatccacacgccttggcctcccaaagtgctgggattgcaggggccaacacatatgaaaagtactggccattttaccagaagcaaggagggcattattttcccaaagatcatttgaaaaaggctgttgctgaaattgaagaaatgtgcaatattttaaaaacggaaggagtgacagtaagga

SEQ ID NO: 8249 - DNA, 549 bp, Homo sapiens
  ENST00000560538
actcaggaaagtccacgggatttaagagctccatgtcaggaacgagagtgaagaccaaacattagaaccaaagattctcctagcacccctgtaactcaggaaattacaagggtgttgggagctctaggccagagactagaggcagagaccatatatatatttcttacttcacaacaggaaaggagagaaggtctctgaggaagtgacattccagctgagacgtgaaggataagtagaaaccaagcagaagaattggaagaggaaagggaagagggaaaagcctgtgccaatgccctgagattggaatatgctttttgtgtttaagaaattaacagaagcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcg

SEQ ID NO: 8250 - DNA, 1107 bp, Homo sapiens
  ENST00000458245
gcgctagggcagactgcgttgctagcagctgagtgaaggccgaaagggccaatggaaacgttagacgacgctcgggcctctgggtagagcgttggtgtccgctttcgtgaaatcgagttgcctaacccagagctttcccgagatggtcttcgttacaggtgtctgggaggcggcttaagctcacttcactaggtcattaagcatgtactttggtggttacatatatcttggaagtcaccggctttacattctgttttcctggccttcgaactggagcatcagtactaccgccgttggaatagcaacctagagactttgctattttgtgaagaaactctaactatccgcatgggcacagaattttgggtgctctggtgcaaatgtctcaggtgacttggcgtaactgagaatacagccttgggaccttcgttctggaggctgggaagtcaaagacaaggcactggcagattccatgactggaaaggagagaaggtctctgaggaagtgacattccagctgagacgtgaaggataagtagaaaccaagcagaagaattggaagaggaaagggaagagggaaaagcctgtgccaatgccctgagattggaatatgctttttgtgtttaagaaattaacagaaggagaagcacatctctggctgccctcagtacactaagagaatcagacctcagaggtggctgcattttattgttgggaataagaagactgcaattcaggaagacatatagtagtctataagtgattcaggactggaactcagttatcctaattccctctcggaggctctttccaccatgccatctgctcgtctggtgctttccatccatgaactctggaaaacaagcttgagataccaaaattgaaaagacagctcatcaaaaatgaatagttataattctataagtacaaaaatgaaatactcaaatctcttgccccccctcctgctaggagcataaatgttaacctgagttctctagctctgtacaaatccacagcaattaagactgcactgtgagggaaaatacttttctaaaaaagaatcctgatcaagttgaaacaaaaattttaaaacatgaaatggaaggaa

SEQ ID NO: 8251 - DNA, 572 bp, Homo sapiens
  ENST00000527933
atgatcatggttgggctttccggtgaccagccctcatctaggagccgggcaagaattgccttggtagaacaaaagactgctcctatcactcaggaaagtccacgggatttaagagctccatgtcaggaacgagagtgaagaccaaacattagaaccaaagattctcctagcacccctgtaactcaggaaattacaagggtgttgggagctctaggccagagactagaggcagagaccatatatatatttcttacttcacaacaggaaaggagagaaggtctctgaggaagtgacattccagctgagacgtgaaggataagtagaaaccaagcagaagaattggaagaggaaagggaagagggaaaagcctgtgccaatgccctgagattggaatatgctttttgtgtttaagaaattaacagaagatcttggggactgagccagagagaagaccaggctccaggaacaaggaagatactgtccagaaatggtttattcatagcaacttcaaggagaagcacatctctggctgccctcagtacactaagagaatcagacctcagaggtggctg

SEQ ID NO: 8252 - DNA, 1257 bp, Homo sapiens
  ENST00000616305
gcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccaggtgcaagttcttcagtctgactgagacgccagaggattacactatcattgtcgatgaggaaggattcctagagctgccctcctcggagcacctgagtgtggcagatgccacctggctggccctgaacgtggtgtccggcggtggcagcttctccagctcccagcccatcggcgtgaccaagatcgccaagtcagtcatcgccccactggctgaccagaacatatccgtgttcatgctgtccacgtatcagacagacttcatcctggtgcgcgagcgggacctgccctttgtcacccacacattgtcatcagagttcaccatcctgcgggtcgtcaatggcgagaccgtggcagccgagaacctcggcatcaccaatggcttcgtgaagcccaagctggtccagaggccagtcatccacccactgtccagcccgagcaacaggttctgtgtcaccagcctggaccctgacacgctgcctgctgttgccacactcctcatggatgtcatgttctactccaatggagtgaaggaccccatggccactggggatgactgcggccacatccgcttcttctccttctccctcatcgagggctacatctccctggtgatggacgtgcagacgcagcagaggtttcctagtaacttgctgttcacaagcgcatccggagagctctggaagatggtccggattggaggacagcccctggggtttgatgagtgtggcatcgtggcccagatctcagagcccttggctgctgcagacatcccagcctactacatcagtactttcaagtttgatcatgcacttgtccccgaagagaacatcaatggtgtcatcagtgccctgaaggtcagccaagcagagaagcactagaagggtctcttctgctcctccctgccgccgcccgggcccagccctaaccctgaagattgatcttgcagtatttctctacagactggaaaatcagcctgg

SEQ ID NO: 8253 - DNA, 809 bp, Homo sapiens
  ENST00000622472
ggaactctgggtgaactgagtcatcatccccagggcacgggtgggcagctgccccaggggacctgcctggactaatgagatattctgtgtctgtccatccatccaggtgcaagttcttcagtctgactgagacgccagaggattacactatcattgtcgatgaggaaggattcctagagctgccctcctcggagcacctgagtgtggcagatgccacctggctggccctgaacgtggtgtccggcggtggcagcttctccagctcccagcccatcggcgtgaccaagatcgccaagtcagtcatcgccccactggctgaccagaacatatccgtgttcatgctgtccacgtatcagacagacttcatcctggtgcgcgagcgggacctgccctttgtcacccacacattgtcatcagagttcaccatcctgcgggtcgtcaatggcgagaccgtggcagccgagaacctcggcatcaccaatggcttcgtgaagcccaagctggtccagaggccagtcatccacccactgtccagcccgagcaacaggttctgtgtcaccagcctggaccctgacacgctgcctgctgttgccacactcctcatggatgtcatgttctactccaatggagtgaaggaccccatggccactggggatgactgcggccacatccgcttcttctccttctccctcatcgagggctacatctccctggtgatggacgtgcagacgcagcagaggtttcctagtaacttgctgttcacaagcgcatccggagagctctggaagatggtccggattggaggacag

SEQ ID NO: 8254 - DNA, 402 bp, Homo sapiens
  ENST00000459785
cagacggacttcatcctggtgcgggagcaggacctgtccgtggtgatccacacgctggcccaggagttcgacatttaccgcgaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgccccgctgacctccgttctgcctctggtggggttgccttccctggccaggtgagtcctgacagtgcctctccctcctggggcctccaaggaaagtattttgacatctctctctcttctgtttttattgacttgttaataaaggactttgtagtgac

SEQ ID NO: 8255 - DNA, 1623 bp, Homo sapiens
  ENST00000407689
agcctcgcagcgggcggcgtggacgcggcagcgcagcggctcctttaaggctcgggcaccacccccgccgccccgcctcccgtgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcctgaacccagctccatcacgttctttgccttctccctcatcgagggttatatctccattgtcatggatgctgaaacacagaaaaagttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgccccgctgacctccgttctgcctctggtggggttgccttccctggccaggtgagtcctgacagtgcctctccctcctggggcctccaaggaaagtattttgacatctctctctcttctgtttttattgacttgttaataaaggactttgtagtgac

SEQ ID NO: 8256 - DNA, 1460 bp, Homo sapiens
  ENST00000404953
ggacgcggcagcgcagcggctcctttaaggctcgggcaccacccccgccgccccgcctcccgtgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacaggttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgccccgctgacctccgttctgcctctggtggggttgccttccctggccaggtgagtcctgacagtgcctctccctcctggggcctccaaggaaagtattttgacatctctctctcttctgtttttatt

SEQ ID NO: 8257 - DNA, 793 bp, Homo sapiens
  ENST00000440839
ccacccccgccgccccgcctcccgtgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccgagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgatgaatgtggcatcgtggcacagattgcaggtcccctggctgccgctgacatctctgcctactacatcagcaccttcaacttcgaccacgccctggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgc

SEQ ID NO: 8258 - DNA, 975 bp, Homo sapiens
  ENST00000421236
cgcagcgggcggcgtggacgcggcagcgcagcggctcctttaaggctcgggcaccacccccgccgccccgcctcccgtgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccgagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcctgaacccagctccatcacgttctttgccttctccctcatcgagggttatatctccattgtcatggatgctgaaacacagaaaaagttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctg

SEQ ID NO: 8259 - DNA, 1143 bp, Homo sapiens
  ENST00000497605
agttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccgagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacaggtggaccttggaacttcgtctttgtcctcacagcactgttccctacactctgtcccaccactttccgcccatctatcagttttgcacctcttgcttgtcctctcttggggttcctggcagcccatgatgctcacttgtgcttcactgatgttcggggaaggttcttgccccaaagctggatccctttccagtggggtcgtctgagccatgccctggtctggccctctcaccgtggaatcctttgtttttggcacaggctgggttcattgtcctcccccatccccacccacaccttccagagggctggacccttgggcgggtagcagatatggcagagcctgcccaggccaccataccagctccttcccagggttctggaggctgatcgggagcaggggcagtaggctgggtgcctggtagagcccctaaacctcccatccctccccagcacccccaaggaggcagcctctagcagtcctgaacccagctccatcacgttctttgccttctccctcatcgagggttatatctccattgtcatggatgctgaa

SEQ ID NO: 8260 - DNA, 740 bp, Homo sapiens
  ENST00000415484
gagccgcgatggagctgcacatcctagaacaccgggtgcgggtgctgagcgtcgcccgtcccggtctctggctctacacccacccgctcatcaagctgctcttcctgccccgccgcagccggtgcaagttcttcagcctgacggagacccctgaggattacacgcttatggtggacgaggagggctttaaagatgaggaaactgagactcaaatcacccaccccaggtcataagacaaattaacaaagctgggatttgaacccagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcc

SEQ ID NO: 8261 - DNA, 794 bp, Homo sapiens
  ENST00000425691
cctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccggtgcgcgcccgggttcgggagcgcagataggggctgggggctctgctctcgctccgggccagggtcggaggattaggatcgccgtaaggcaggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcc

SEQ ID NO: 8262 - DNA, 949 bp, Homo sapiens
  ENST00000463795
agttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgcagggcccagccccacggtgcatcccatccagagcccacagaaccgcttctgtgtcctcacactggaccctgagacgcttccagccatcgccaccaccctcatagatgtcctcttctactcgcacaggtggaccttggaacttcgtctttgtcctcacagcactgttccctacactctgtcccaccactttccgcccatctatcagttttgcacctcttgcttgtcctctcttggggttcctggcagcccatgatgctcacttgtgcttcactgatgttcggggaaggttcttgccccaaagctggatccctttccagtggggtcgtctgagccatgccctggtctggccctctcaccgtggaatcctttgtttttggcacaggctgggttcattgtcctcccccatccc

SEQ ID NO: 8263 - DNA, 966 bp, Homo sapiens
  ENST00000471480
gtgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccgagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatggtgagggccgccccctgacacttggacttgggcagggcctcctcttcccactgggtcccttcccttttgggccccagtggggcaggaggaccccggccagttcctggatagcaagacctgcccctggcccacgcctctccctgactagccaccagggggcgccccagcccacggacaccttttcacctgctgctgtcctccagcagggcccagccccacggtgcatcccatccagagcccacagaaccgcttctgtgtcctcacactggaccctgagacgcttccagccatcgccaccaccctcatagatgtcctcttctactcgcacaggtggaccttggaacttcgtctttgtcctcacagcactgttccctacactctgtcccaccactttccgcccatctatcagttttgcacctcttgcttgtcctctcttggggttcctggcagcccatgatgctcacttgtgcttcactgatgttc

SEQ ID NO: 8264 - DNA, 704 bp, Homo sapiens
  ENST00000492159
aaacagcctgggatgggcaatgcttaactcagtagtgtcaaatgggggcattcctacctggtcactgcggggagctccttccaggacgcctcccttcatgtcagaggggctggactagggggtccaaggtccgacgcccctggggctgtcgccgcgggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgagtttcctgctggtgctgatgcagagcagggtggatataggtacctgggagcccatgtgatgtgccatctgctgtggcccaggtgcgggagcaggacctgtccgtggtgatccacacgctggcccaggagttcgacatttaccgcgaggtgggcggagagcctgtgcctgtgacgagggatgattccagcaatggctttccccgcactcagcatggtgagggccgccccctgacacttggacttgggcagggcctcctcttcccactgggtcccttcccttttgg

SEQ ID NO: 8265 - DNA, 580 bp, Homo sapiens
  ENST00000440704
tggagctgcacatcctagaacaccgggtgcgggtgctgagcgtcgcccgtcccggtctctggctctacacccacccgctcatcaagctgctcttcctgccccgccgcagccggtgcgcgcccgggttcgggagcgcagataggggctgggggctctgctctcgctccgggccagggtcggaggattaggatcgccgtaaggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttcccc

SEQ ID NO: 8266 - DNA, 340 bp, Homo sapiens
  ENST00000464854
gccccctggtggtgccatgtggtacaaagcttctgctaacccacagaagacaccgtagtgagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtg

SEQ ID NO: 8267 - DNA, 372 bp, Homo sapiens
  ENST00000498572
gtgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccggtgcgcgcccgggttcgggagcgcagataggggctgggggctctgctctcgctccgggccagggtcggaggattaggatcgccgtaagagctgcccccatctgagttcctgcaagtagctgaggccacatggctggtgctgaacgtgtcgtctcacagcggtgcggcagtgcaggctgctggggtcaccaagatcgcccgttcggtcatc

SEQ ID NO: 8268 - DNA, 2922 bp, Homo sapiens
  ENST00000459805
gagactctggaacccctgtgctcttctcctcatctagtgaccctgaggtgatggagttttcaagtccttccagagaggaatgtcccaagccttcgggtagggtaagcatcatggctggcagcctcacaggattgcttctacttcaggcagtgtcgtgggcatcagatgagtgagtcaaggcagtggggaggtagcacagagcctcccttctgcctcatagtcctttggtagccttccagtaagctggtggtagacttttagtaggtgctcaataaatccttttgagtgactgagaccaactttggggtgaggatttttgaaaccgtcttcagtctctccaaacagctgtgtccgttctccacatccttgtcagacctcacctctgcttgtgctccctccctcccaggtggtgcccctgcatccctaaaagcttcagtacagctcggtggtctgtgtctgcaatgccacatactgtgactcttgaccccccgacctttcctgccctaggtgccttcagccgctacaagagcagaagcagtgggcattggatggagctgagtacaggaccatacaggctaattgcaccggcacaggtaaccattacacccttcaccccccgggccaggctgggtcctcctagaggtaaacggtgtcagtgatcaccatggagtttctcccctgggcactgataaccctgtggatgtcctcaggcctgctactgatcctgcagccagaagttccagaaagtgaagggatttggaggggccgtgacagatgcaggtgccctcaacatccttgccctgtcaccccctgcccagaatttgctacttaaatggtacttctctgaagaagatgaggaggaaggggacaggatgacatagagccactgacacttttctttgccaattctttggaccctgacttctgcccatccctgacatttggttcctgtcttaatgccagtgaaataagatttcgccgcctatcatctgctaactgctacggactcaggctcagaaaggcctgcgcttcacccaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaggggagcggggaatgggaaggggccactcaagggacagcccagagacatctaccaccagacctgggccagatacattgtgaagtaagggatcagcaaggatgtgggatcaggactggcctcccctttggccatgctgatctgtgtcccaaccctcaacctggttccacttccagatctgcctgtcctcagctcacctttctaccttctgggcctttcaaacttggatctgtcagtcttgcccactccatcaggcttcctgttctctcggtctggcccactttcttggctggatcattcatgacctttctcttgccaggttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctacccttgccaacggtactcaccacaatgtccgcctactcatgctggatgaccaacgcttgctgctgccccactgggcaaaggtggtactgacagacccagaagcagctaagtatgttcatggtattgctgtacattggtacctggactttctggctccagccaaagccaccctaagggagacacaccacctgttccccaacaccatgctctttgcctcagaggcctgtgtgggttccaagttctgggagcagagtgtgcggctaggctcctgggatcgagggatgcagtacagccacagcatcatcacaaacctcctgtaccatgtggtcggctggaccgactggaacccatcattgtagacatcaccaagcacacgttttacaaacagcccatgttctaccaccttggccacttcagcaagttcattcctgagggctcccagagagtggggctggttgccagtcagaagaacgacccggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtca

SEQ ID NO: 8269 - DNA, 1884 bp, Homo sapiens
  ENST00000486869
gtggatcctctatccttcagagactctggaacccctgtgctcttctcctcatctagtgaccctgaggtgatggagttttcaagtccttccagagaggaatgtcccaagccttcgggtagggtaagcatcatggctggcagcctcacaggattgcttctacttcaggcagtgtcgtgggcatcagatgagtgccttcagccgctacaagagcagaagcagtgggcattggatggagctgagtacaggaccatacaggctaattgcaccggcacagtgaaataagatttcgccgcctatcatctgctaactgctacggactcaggctcagaaaggcctgcgcttcacccaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaggggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctacccttgccaacggtactcaccacaatgtccgcctactcatgctggatgaccaacgcttgctgctgccccactgggcaaaggtggtactgacagacccagaagcagctaaaggcctgtgtgggttccaagttctgggagcagagtgtgcggctaggctcctgggatcgagggatgcagtacagccacagcatcatcacaaacctcctgtaccatgtggtcggctggaccgactggaacccatcattgtagacatcaccaagcacacgttttacaaacagcccatgttctaccaccttggccacttcagcaagttcattcctgagggctcccagagagtggggctggttgccagtcagaagaacgacccggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagccca

SEQ ID NO: 8270 - DNA, 1873 bp, Homo sapiens
  ENST00000368374
cttttgccttcggttggggctgctgtttctcttcgccgacggtgacagggctttccctatgttgcccaggttcgtctcaaactcctgggctcaaaagatcctcatcttctcaagtggttgaatatacacgctccagcgaccatgcctggctgaatgaagagctttgagattttgaagaaacaggaaccatgaaatttgctttgcaactgtttgcaacctttaaggaagactgaaaaggcattcctgaagcatgtgccttcagccgctacaagagcagaagcagtgggcattggatggagctgagtacaggaccatacaggctaattgcaccggcacaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaggggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctacccttgccaacggtactcaccacaatgtccgcctactcatgctggatgaccaacgcttgctgctgccccactgggcaaaggtggtactgacagacccagaagcagctaaaggcctgtgtgggttccaagttctgggagcagagtgtgcggctaggctcctgggatcgagggatgcagtacagccacagcatcatcacaaacctcctgtaccatgtggtcggctggaccgactggaacccatcattgtagacatcaccaagcacacgttttacaaacagcccatgttctaccaccttggccacttcagcaagttcattcctgagggctcccagagagtggggctggttgccagtcagaagaacgacccggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagccca

SEQ ID NO: 8271 - DNA, 1823 bp, Homo sapiens
  ENST00000486197
cccaagccttcgggtagggtgccttcagccgctacaagagcagaagcagtgggcattggatggagctgagtacaggaccatacaggctaattgcaccggcacagtgaaataagatttcgccgcctatcatctgctaactgctacggactcaggctcagaaaggcctgcgcttcacccaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaggggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctacccttgccaacggtactcaccacaatgtccgcctactcatgctggatgaccaacgcttgctgctgccccactgggcaaaggtggtactgacagacccagaagcagctaagtatgttcatggtattgctgtacattggtacctggactttctggctccagccaaagccaccctaagggagacacaccacctgttccccaacaccatgctctttgcctcagaggcctgtgtgggttccaagttctgggagcagagtgtgcggctaggctcctgggatcgagggatgcagtacagccacagcatcatcacaaacctcctgtaccatgtggtcggctggaccgactggaacccatcattgtagacatcaccaagcacacgttttacaaacagcccatgttctaccaccttggccacttcagcaagttcattcctgagggctcccagagagtggggctggttgccagtcagaagaacgacccggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagccc

SEQ ID NO: 8272 - DNA, 2711 bp, Homo sapiens
  ENST00000473223
ggaagccagaattacttgcaggagtaacctagtgcctatagctatggcaggtacctgcatccttgtttttgtttagtggatcctctatccttcagagactctggaacccctgtgctcttctcctcatctagtgaccctgaggtgatggagttttcaagtccttccagagaggaatgtcccaagccttcgggtagggtaagcatcatggctggcagcctcacaggattgcttctacttcaggcagtgtcgtgggcatcagatgagtgccttcagccgctacaagagcagaagcagtgggcattggatggagctgagtacaggaccatacaggctaattgcaccggcacaggtaaccattacacccttcaccccccgggccaggctgggtcctcctagaggtaaacggtgtcagtgatcaccatggagtttctcccctgggcactgataaccctgtggatgtcctcaggcctgctactgatcctgcagccagaagttccagaaagtgaagggatttggaggggccgtgacagatgcaggtgccctcaacatccttgccctgtcaccccctgcccagaatttgctacttaaatggtacttctctgaagaagatgaggaggaaggggacaggatgacatagagccactgacacttttctttgccaattctttggaccctgacttctgcccatccctgacatttggttcctgtcttaatgccagtgaaataagatttcgccgcctatcatctgctaactgctacggactcaggctcagaaaggcctgcgcttcacccaggtgccagcctccacaggttccaacccaggagcccaagttccttttggccctgactcagacactattaggactggcaagtgataagcagagtcccatactctcctattgactcggactaccatatcttgatcatccttttctgtaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaggggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctacccttgccaacggtactcaccacaatgtccgcctactcatgctggatgaccaacgcttgctgctgccccactgggcaaaggtggtactgacagacccagaagcagctaaaggcctgtgtgggttccaagttctgggagcagagtgtgcggctaggctcctgggatcgagggatgcagtacagccacagcatcatcacagtctgcacacctcattgccccttttgcaactactgaggcacttgcagctgcctcagacttctcagctccccttgagatgcctggatcttcacacccccaactccttagctactaaggaatgtgcccctcacagggctgacctacccacagctgcctctcccacacgtgacccttacctacactctctggggacccccagtgttgcgcctttgtctccttgcctttgtccttaccctagaacctcctgtaccatgtggtcggctggaccgactggaacccatcattgtagacatcaccaagcacacgttttacaaacagcccatgttctaccaccttggccacttcagcaagttcattcctgagggctcccagagagtggggctggttgccagtcagaagaacgacccggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagccc

SEQ ID NO: 8273 - DNA, 1546 bp, Homo sapiens
  ENST00000566701
atggagttttcaagtccttccagagaggaatgtcccaagccttcgggtagggtaagcatcatggctggcagcctcacaggattgcttctacttcaggcagtgtcgtgggcatcaggtggtgcccctgcatccctaaaagcttcagtacagctcggtggtctgtgtctgcaatgccacatactgtgactcttgaccccccgacctttcctgccctaggtgccttcagccgctacaagagcagaagcagtgggcattggatggagctgagtacaggaccatacaggctaattgcaccggcacaggcctgctactgatcctgcagccagaagttccagaaagtgaagggatttggaggggccgtgacagatgcaggtgccctcaacatccttgccctgtcaccccctgcccagaatttgctacttaaatggtacttctctgaagaaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaggggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctacccttgccaacggtactcaccacaatgtccgcctactcatgctggatgaccaacgcttgctgctgccccactgggcaaaggtggtactgacagacccagaagcagctaagtatgttcatggtattgctgtacattggtacctggactttctggctccagccaaagccaccctaagggagacacaccacctgttccccaacaccatgctctttgcctcagaggcctgtgtgggttccaagttctgggagcagagtgtgcggctaggctcctgggatcgagggatgcagtacagccacagcatcatcacaaacctcctgtaccatgtggtcggctggaccgactggaacccatcattgtagacatcaccaagcacacgttttacaaacagcccatgttctaccaccttggccacttcagcaagttcattcctgagggctcccagagagtggggctggttgccagtcagaagaacgacccggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtga

SEQ ID NO: 8274 - DNA, 830 bp, Homo sapiens
  ENST00000463838
gaggatttttgaaaccgtcttcagtctctccaaacagctgtgtccgttctccacatccttgtcagacctcacctctgcttgtgctccctccctcccaggtggtgcccctgcatccctaaaagcttcagtacagctcggtggtctgtgtctgcaatgccacatactgtgactcttgaccccccgacctttcctgccctaggtgccttcagccgctacaagagcagaagcagtgggcattggatggagctgagtacaggaccatacaggctaattgcaccggcacaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaggggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctacccttgccaacggtactcaccacaatgtccgcctactcatgctggatgaccaacgcttgctgctgccccactgggcaaaggtg

SEQ ID NO: 8275 - DNA, 529 bp, Homo sapiens
  ENST00000462587
cattgggaagccagaattacttgcaggagtaacctagtgcctatagctatggcaggtacctgcatccttgtttttgtttagtggatcctctatccttcagagactctggaacccctgtgctcttctcctcatctagtgaccctgaggtgatggagttttcaagtccttccagagaggtgccttcagccgctacaagagcagaagcagtgggcattggatggagctgagtacaggaccatacaggctaattgcaccggcacaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaggggagcggggaatgggaaggggccactcaagggacagccca

SEQ ID NO: 8276 - DNA, 814 bp, Homo sapiens
  ENST00000473240
gaaagcgaattctctctgacaccaagaccaacgctctagcaaagctcctccggcggatattttgttttcccagcaggttctgccttaacaataaggtcctttgtaggccaaaatgtgcagggcataaaagcatgtgatttgggactttccaaaggggaagtgaacagaaactgccacagacccggacgtgaacagggagttaccctcggctggtgaatgtaggcaggcctggctgagggtggtgagactgcgagggacaggtgagagatgaagctcagaagacatctttgcagagatgtggagaagacaggaggaagtccttcctaaaataaacctgacctcctattgctggtatttatgcagctttgaccaggacctggtaacagatgtggatggacttgaaccaccaactcagcttagaaggaagccaagacttaaagtttcctagatcccagctttttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaactt

SEQ ID NO: 8277 - DNA, 691 bp, Homo sapiens
  ENST00000446271
ctcctccggcggatattttgttttcccagcaggttctgccttaacaataaggtcctttgtaggccaaaatgtgcagggcataaaagcatgtgatttgggactttccaaaggggaagtgaacagaaactgccacagacccggacgtgaacagggagttaccctcggctggtgaatgtaggcaggcctggctgagggtggtgagactgcgagggacaggtgagagatgaagctcagaagacatctttgcagagatgtggagaagacaggaggaagtccttcctaaaataaacctgacctcctgtgggttcccaaacactaacttgtttccctgggaatttggaggtgggttcgaaaaatttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctct

SEQ ID NO: 8278 - DNA, 824 bp, Homo sapiens
  ENST00000429691
gggagttaccctcggctggtgaatgtaggcaggcctggctgagggtggtgagactgcgagggacaggtgagagatgaagctcagaagacatctttgcagagatgtggagaagacaggaggaagtccttcctaaaataaacctgacctcctgtgggttcccaaacactaacttgtttccctgggaatttggagtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaa

SEQ ID NO: 8279 - DNA, 1992 bp, Homo sapiens
  ENST00000437150
ggcctgcggaagggggcgggttcggaggagtgaactgtgcggttagtgcgcctttcagcctcacctgcagctgcgcctccttgcacctgcgcctgtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactctaattgttcagaaattttacatttgacttatttgacaacattaacattagtggtggctttgccattaaaaacccagtaagtattttgagtgcatctatgtgatgtggtgttttgagcatagtaggcaccacagcaacttttctgcgtggtactaaaactgccgaaaatgcgacgtagaatcaccagatctttagtgtttaatatccctggtataagatgttataattaatgtaatttctttcttggcaaacacctcatgtctgtcttagtgaagatttaataaaccacttatttttcttat

SEQ ID NO: 8280 - DNA, 605 bp, Homo sapiens
  ENST00000481161
tgcgcctttcagcctcacctgcagctgcgcctccttgcacctgcgcctgtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatgtatccttgaatagaaatagaaaatactagaataaagagtaattgctttctgactatcaagccagtggttagatttcagtgcctgtagtaaactagtgaatttaaaaatactttgtaagatcctgtttaaattctaggctttctagtttttatgcagaagtctgttcatataatgagtttggct

SEQ ID NO: 8281 - DNA, 652 bp, Homo sapiens
  ENST00000453113
gcgcctttcagcctcacctgcagctgcgcctccttgcacctgcgcctgtgctttttctcccagcactgcggacgcgactcgagggtgacgctcgctccgctcgtcccgctcgtcatggcctacccgggatacggaggagggaagctgactgccaagctatgaaaaagtggaagagccatgtgaaagggcccatgtggaggagaactggggcccctggccaacaagtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgg

SEQ ID NO: 8282 - DNA, 1808 bp, Homo sapiens
  ENST00000487445
tgcgcctccttgcacctgcgcctgtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacaggtattgactatttaaaactaagtgcacagtgttatgtagctatttttcttgaataatgtgtctcatttcctccagcaagtttataataatatgtgttttctccctttattcactgttaaatctaattagtttaaaggcttcaaatattaaggaatataaatgataaaaacgttatgttatttttggaagtttttctcatatctctgttgccagggctattcaatcacttaatatttaattgaatatgaaattattctttttgtgtacctgggtgcactaaatatttgaaactatgtattttaaattacaataaaaaagtaatttctttgtttaaagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaa

SEQ ID NO: 8283 - DNA, 597 bp, Homo sapiens
  ENST00000479199
gtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggtaagaacattaacattctttagaatctataaagctaatctttgttctttgattagatgaacttaattgcttcaat

SEQ ID NO: 8284 - DNA, 1694 bp, Homo sapiens
  ENST00000233612
tgccaacgtgcgggtccgcccttggctcctgctccctgcgtccgcgcctggtactcggcggcgccggattccggggctgttgggggccagggcctgggcgagcattgatcctgggctgacttggagccgcaggttttctggtcgttgaggaccctcgaggagcgtcctggtggagccgagggagtaattttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactctaa

SEQ ID NO: 8285 - DNA, 655 bp, Homo sapiens
  ENST00000414723
ccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattgtggaggaatgaacgtaattaactttgaacatcttgatacagaaagacctgaatctgtgtgcaaaagtgactaagttccctttatccccctggaattcccatgagttgaggatcatctgaatttgagttgcatccatgaacagttttatcccttggtttcttatttgcgtggaaggcattttcataacgaagtactggtttagtaaaagcagtaaataggagtctccatgcaagagaaattggagtttcctaacatgcatgtgatttaaaaaataaaaataaaaaataa

SEQ ID NO: 8286 - DNA, 1897 bp, Homo sapiens
  ENST00000543643
ctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacgaagtcaaataaatataataaagggttgagccctctactttcttcttgccacctttttgtggcaatattaaagtgaactgctaatagtgtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaaggtggtcctatttaaattattaaactattgtaactttg

SEQ ID NO: 8287 - DNA, 2943 bp, Homo sapiens
  ENST00000491895
aaaaaggaggcgcggccgggctttccagcctgtggccgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaaggtggtcctatttaaattattaaactattgtaactttg

SEQ ID NO: 8288 - DNA, 2901 bp, Homo sapiens
  ENST00000254299
ccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaaggtggtcctatttaaattattaaactattgtaacttt

SEQ ID NO: 8289 - DNA, 1805 bp, Homo sapiens
  ENST00000536224
cgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacgtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaaggtggtcctatttaaattattaaac

SEQ ID NO: 8290 - DNA, 351 bp, Homo sapiens
  ENST00000395521
ccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggtctgcagaaccatagcttccacgcacctgaacgagcacagaatgaactgacggtggaa

SEQ ID NO: 8291 - DNA, 2923 bp, Homo sapiens
  ENST00000622544
cctgtggccgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaaggtggtcctatttaaattattaaactattgtaactttgttcttgtg

SEQ ID NO: 8292 - DNA, 1977 bp, Homo sapiens
  ENST00000395514
cctgtggccgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaaggtggtcctatttaaattattaaactattgtaactttgttcttgtg

SEQ ID NO: 8293 - DNA, 1641 bp, Homo sapiens
  ENST00000459642
gggatgccaagagcagggatgggagcgagcctgcgtccgggcactggtccccatccgtgagtcccctcggtgctccctgcccgccgtggccatcctctcacatcactcacaaccccaaggcgcggcatggttgacacccccacgttaggacggagaccctgggcttagttagagggggcagtactaaccagtccctggcggaaacgctttggctgggtgaggtgagcgggatcgcccccatttctccagagaggggtcccggctcagcgagggaaagaggccgccgctggggggacggctggccggggcccctccctggagaacgagaggccgccgctggagggggatggactgtcggagcgacactcagcgaccgccctacctcctcccgccccgcagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaaca

SEQ ID NO: 8294 - DNA, 1311 bp, Homo sapiens
  ENST00000336642
ggcggggtccggacggggatgccaagagcagggatgggagcgagcctgcgtccgggcactggtccccatcccgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaa

SEQ ID NO: 8295 - DNA, 2729 bp, Homo sapiens
  ENST00000403799
gagcaggaaatgccgagcggcgcctgagccccagggaagcaggctaggatgtgagagacacagtcacctgcagcctaattactcaaaagctgtccccaggtcacagaagggagaggacatttcccactgaatctgtctgaaggacactaagccccacagctcaacacaaccaggagagaaagcgctgaggacgccacccaagcgcccagcaatggccctgcctggagaacatccaggctcagtgaggaagggtccagaagggaatgcttgccgactcgttggagaacaatgaaaaggaggaaactgtgactgaacctcaaaccccaaaccagcccgaggagaaccacattctcccagggacccagggcgggccgtgacccctgcggcggagaagccttggatatttccacttcagaagcctactggggaaggctgaggggtcccagctccccacgctggctgctgtgcagatgctggacgacagagccaggatggaggccgccaagaaggagaaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaa

SEQ ID NO: 8296 - DNA, 2539 bp, Homo sapiens
  ENST00000395796
aagccctgggctgccagcctcaggcagctctccatccaagcagccgttgctgccacaggcgggccttacgctccaaggctacagcatgtgctaggcctcagcaggcaggagcatctctgcctcccaaagcatctacctcttagcccctcggagagatggcgatggatgtcacaaggagccaggcccagacagccttgactctgccagactctcctctgaactcgggcctcacatggccaactgctacttggaacaaatcgccccttggctggcagatgtgttaacatgcccagaccaagatcccaactcccacaacccaactcccaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagtttta

SEQ ID NO: 8297 - DNA, 2421 bp, Homo sapiens
  ENST00000345378
agtgcagaagccctgggctgccagcctcaggcagctctccatccaagcagccgttgctgccacaggcgggccttacgctccaaggctacagcatgtgctaggcctcagcaggcaggagcatctctgcctcccaaagcatctacctcttagcccctcggagagatggcgatggatgtcacaaggagccaggcccagacagccttgactctggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagtttt

SEQ ID NO: 8298 - DNA, 1385 bp, Homo sapiens
  ENST00000437084
ggggtcccagctccccacgctggctgctgtgcagatgctggacgacagagccaggatggaggccgccaagaaggagaaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagc

SEQ ID NO: 8299 - DNA, 404 bp, Homo sapiens
  ENST00000473353
tttatttaaattaaatacggaaggtcatagattaagcaagaaagtgccagcaacatggtgcgtgcctctgactgggcactaaccctccaagtcttagttttcccaaccataactggccaatgaacagcagctctggatgcagctaaaggaagactgaagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccg

SEQ ID NO: 8300 - DNA, 553 bp, Homo sapiens
  ENST00000476008
tgaacccttctttttgcttgcgttgttgaaagaaggcaagtctatggataggaatgagtgaggcacagctccctgaggatgccatatcttgcccgtttcttgtgtattaagtgacatcacgtgttaccaaactaaaccggctgcatttgcctgcgcacaacataaaaccaaacacccaagcattggatttttgtagcaagaaagatgtattgccaagcagccttgcaaggggacagaagacgggctcaaatctgtctcccaatacttgcttcgcagcagtagatttaagggagagattttggaagtggagtttcgggctggacggtgattggctgaaacgaagaagtgtttagaaaatctcttggtcatgagctgttgcttcttcatgctgcttcaagggtcacatgcagattcaggaggtggtataaaacaagctgtgggaatttgggctgtgacatcaaagggccgctcctcgggctagtagagcagatcctggcagagttccagctgcaggaggaggacctgaagaaggtgatgagacggatgcagaagg

SEQ ID NO: 8301 - DNA, 2260 bp, Homo sapiens
  ENST00000616242
atgcccagaccaagatcccaactcccacaacccaactcccaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaacatg

SEQ ID NO: 8302 - DNA, 1771 bp, Homo sapiens
  ENST00000376986
agcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaatgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaacagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgaaagaaacaattcacttaccagcctcctcaccccatcctccaccatttccttaatgttccatggtattttcaacggaatacactttgaaagttctcagaataactgtagaatgtgctggaaatggaacattctcagataaggaggaactggccagatcaaactaagctgtgttcccatccctcctgaaacaggatcttatggtgctttagcccaggacgtcaagtatcccctaggtatgaaacccagagtggagcatgctttgaaggtccctcagctacatgcagactagactgcatgtagctgactctaactgccctgggaaactatcctgagctttgacagacctgccatgaatcttaagcttttattgtcccttgctgcctatctgtgaggaataaagttgcttcacttac

SEQ ID NO: 8303 - DNA, 5340 bp, Homo sapiens
  ENST00000358399
cggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccaaaggaacttgattacatggtgtctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaattttttttttttggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 8304 - DNA, 2019 bp, Homo sapiens
  ENST00000475764
gcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggaaagaaacaattcacttaccagcctcctcaccccatcctccaccatttccttaatgttccatggtattttcaacggaatacactttgaaagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 8305 - DNA, 2359 bp, Homo sapiens
  ENST00000477618
attgtactgtggctgggctgaactcaaaccacaagatacagtccttcccactcttccttcccctttttgaaggtggaggagccttaccttgtgtccactgccaccacaggtcccctggaagtcctgccagactactgcctatgttcccttaaagcccaaggattcttagtcaacttgtgaattctgcctggcctgggataaactcttcagagcagtgggcttccctttggcccagggcagatccataaatgctgtgtaagagccaagttctggaactggggactccaggagcctgcttgatgttttattcttctgtggccgaactggtacctaaagttgtttttagaagaagcatctcaacaggaaaaactggccaaagaatggtgcttcaagccgtgtgaaataagagaactgagccaccagattagaagaaggcttggaagcagttgaagtagaggctgagatgggatgagagaatggtggaaacggttggaggatggagaggagggtaaacataacttgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgtaagtagacaatgattgtttggtagattacgaatgattgggttgcagattagcagccaaatgcctttgtttcctctgtcattcctccaggatctcccctctattctgtgtttggcaggacccagatagatagacatttactcgtgctgttgaggagtaaaagagaacacgtaagaggacatttatctcagaggacacgtgaagagcacagcatcttctgaaatctctgagtttgtacaaaaaaaggacaatagggaatacaacataaaaaatttacagtgaaagtactgaaagaacccatatgtcagccaggaaatccagaagagggtagtcactcccattactgtttgtgctgtagtgtgagaaggaaacacagcaataccaaagcaaatgcactatgatgtatgttaccctgttggacctgacggaatgccagcccacacaggcaagcccaggaggaccttgtcctattataattccccagaatacagaggtgttatttattaactggttcttaaccttttgaaaggtgatggatccgtaaatgaataaaatgaaagttattgcctgggcgcagtggctcacatctgtaatcctagcactttgggaagcagaggcaggcagatcacttgaggtcaggagttcaagaccaccctgaccaacatggtgaaaccccatcagtattaaacatataaaaattagctgggcatggtggcaggcacctgtaatcccaaccactcaggaggctgaggcaagagaatcgtttgaacccgggaggcggaggttgcagtgagccaagattgcaccactgcactccagcctgggtgacagagtgagactctgtctcagaaaaataaataagttatagcctgtaatttcaggggaaaaaagcccatggatattacaagtgttgcatctaatttcagggaattcatagatctcatgatgccagtccatggatgctaggttaaaaacccatgcttgtggctgtaatctcagaaaacaacttcaggggtcgggcgtggtggctcacacctctaatcccagcactttgggaggccaaggtgggcggatcacgaggtcaggagatcgagaccatcccggctaacacggtgaaacccagtctctact

SEQ ID NO: 8306 - DNA, 694 bp, Homo sapiens
  ENST00000414671
cagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagactgtcactctgtcacccaggctggagtgcaatggcgcgatctcagctcactgaaacctccacctcctgtgttcaagagattctcctgcctcagcctcccgagtagctgggattacagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacag

SEQ ID NO: 8307 - DNA, 888 bp, Homo sapiens
  ENST00000489618
acggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggaaagaaacaattcacttaccagcctcctcaccccatcctccaccatttccttaatgttccatggtattttcaacggaatacactttgaaaggctgatcttgatatcctggtctcaagtgatcctcccacctcagcattctaaagtgctaggattacagacatgagctactgcacccagccaattggaggccttgccccagcaggtggggaaggaaatgccagccaagttcccaccacatgcagaaacctgagagggtgaaccctacccatcaacacctggagaccttttcctg

SEQ ID NO: 8308 - DNA, 990 bp, Homo sapiens
  ENST00000436438
gaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgaaagaaacaattcacttaccagcctcctcaccccatcctccaccatttccttaatgttccatggtattttcaacggaatacactttgaaagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 8309 - DNA, 2074 bp, Homo sapiens
  ENST00000238018
agaaaaatcctattggcattgaggaggtagggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgaaagaaacaattcacttaccagcctcctcaccccatcctccaccatttccttaatgttccatggtattttcaacggaatacactttgaaagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtt

SEQ ID NO: 8310 - DNA, 5362 bp, Homo sapiens
  ENST00000545168
attctcccgcctcagtctcctgagtagccgggactacaggcacccgctacaacgcccggctaattttttttgtatttccccttccttctttgctttcaaaatccaggcttaggggtacaaaaacctatattgtctgagacaggaagcactccgaagtttgaagaagagggcagcagcccaactcagaagaactggactccccagcactataaggagagagggtggtggttccaccagagatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccaaaggaacttgattacatggtgtctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaattttttttttttggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtt

SEQ ID NO: 8311 - DNA, 2458 bp, Homo sapiens
  ENST00000580279
gccgactcgggctcggctcggctctgcgctgctccggacggctgtgaccgctggccgggggctcgggccgccggtacccacggaccgcgcgcccgggtgcctgctccgctaagcccctcgccccgcgcggacctcggtatccagcgccctgctgcccgggctctccccgcgcgccctactgccgcgaggtcagtccgcagcctccggtgcgccagcgctcgccttcctcctcctggacttcggccctttgccgccctcaccacgccatggctcatgtccccgctcggaccagcccgggacccgggccccagctgctgctgctgctgctgccgttgtttctgctgttgctccgggatgtggccggcagccacagggcccccgcctggtccgcactgcccgcggccgccgacggcctgcagggggacagggatctccagcggcaccctggggacgcggccgccacgttgggccccagcgcccaggacatggtcgctgtccacatgcacaggctctatgagaagtacagccggcagggcgcgcggccgggagggggcaacacggtccgcagcttcagggccaggctggaagtggtcgaccagaaggccgtgtatttcttcaacctgacttccatgcaagactcggaaatgatccttacggccactttccacttctactcagagccgcctcggtggcctcgagcgctcgaggtgctatgcaagccgcgggccaagaacgcttcaggccgcccgctgcccctgggcccgcccacacgccagcacctgctcttccgcagcctctcgcagaacacggccacacaggggctactccgcggggccatggccctggcgcccccaccgcgcggcctgtggcaggccaaggacatctcccccatcgtcaaggcggcccgccgggatggcgagctgctcctctccgcccagctggattctgaggagagggacccgggggtgccccggcccagcccctatgcgccctacatcctagtctatgccaacgatctggccatctcggagcccaacagcgtggcagtgacgctgcagagatacgaccccttccctgccggagaccccgagccccgcgcagcccccaacaactcagcggacccccgcgtgcgccgagccgcgcaggccactgggcccctccaggacaacgagctgccggggctggatgagaggccgccgcgcgcccacgcacagcacttccacaagcaccagctgtggcccagccccttccgggcgctgaaaccccggccagggcgcaaagaccgcaggaagaagggccaggaggtgttcatggccgcctcgcaggtgctggactttgacgagaagacgatgcagaaagcccggaggaagcagtgggatgagccgagggtgtgctcccggaggtacctgaaggtggacttcgcagacatcggctggaatgaatggataatctcaccgaaatcttttgatgcctactactgcgcgggagcatgtgagttccccatgcctaagatcgttcgtccatccaaccatgccaccatccagagcattgtcagggctgtgggcatcatccctggcatcccagagccctgctgtgttcccgataagatgaactcccttggggtcctcttcctggatgagaatcggaatgtggttctgaaggtgtaccccaacatgtccgtggacacctgtgcctgccggtgagaccactccagggtggaaagaagccacgcccagcagagctgccttctcggagccttctgcaaccaggacttgtggtgcagctgcagacacagagcacagctcatgggcaacatcactggggcccagagagagctgtccgccagtgcatcattagggggtctttcattgctagtgactagccccttaaatgccagcctgagtacctgaaggaatctgggaattagccctggcctgaaagtggcccatcattcatacccactgttctgaaggcttgaaaacaaaacatatccacaacattggcttgatgtgatcatcatctcataactgagcaagaagactatgcaaatcttagggcgctcgctccctgcacacggaaagaactctgtttaaatgctcagttcagaacactttgggccacatagtgattttggaaaacaggataatcgtggtgtaaatgagtgtttcctttcaaagtccactgcagagcttttatccatatggtatgcacatgtagccaatattggtttctttttcttaatatatatattttattttaaaacaacaaaaagggagggcgttgacaccattccccacagagatagtcatgctgagtgtgggttgtttaaacatgcatattgaaataacacatatagtaacgtgggaatactaaaaaataaccaagattttatatttttgtaaattatactttctatactgtagattgtgtatgttatgtgtttttatggaaagctaat

SEQ ID NO: 8312 - DNA, 8657 bp, Homo sapiens
  ENST00000257868
tccccgccccccagtcctccctcccctcccctccagcatggtgctcgcggccccgctgctgctgggcttcctgctcctcgccctggagctgcggccccggggggaggcggccgagggccccgcggcggcggcggcggcggcggcggcggcggcagcggcgggggtcgggggggagcgctccagccggccagccccgtccgtggcgcccgagccggacggctgccccgtgtgcgtttggcggcagcacagccgcgagctgcgcctagagagcatcaagtcgcagatcttgagcaaactgcggctcaaggaggcgcccaacatcagccgcgaggtggtgaagcagctgctgcccaaggcgccgccgctgcagcagatcctggacctacacgacttccagggcgacgcgctgcagcccgaggacttcctggaggaggacgagtaccacgccaccaccgagaccgtcattagcatggcccaggagacggacccagcagtacagacagatggcagccctctctgctgccattttcacttcagccccaaggtgatgttcacaaaggtactgaaggcccagctgtgggtgtacctacggcctgtaccccgcccagccacagtctacctgcagatcttgcgactaaaacccctaactggggaagggaccgcagggggagggggcggaggccggcgtcacatccgtatccgctcactgaagattgagctgcactcacgctcaggccattggcagagcatcgacttcaagcaagtgctacacagctggttccgccagccacagagcaactggggcatcgagatcaacgcctttgatcccagtggcacagacctggctgtcacctccctggggccgggagccgaggggctgcatccattcatggagcttcgagtcctagagaacacaaaacgttcccggcggaacctgggtctggactgcgacgagcactcaagcgagtcccgctgctgccgatatcccctcacagtggactttgaggctttcggctgggactggatcatcgcacctaagcgctacaaggccaactactgctccggccagtgcgagtacatgttcatgcaaaaatatccgcatacccatttggtgcagcaggccaatccaagaggctctgctgggccctgttgtacccccaccaagatgtccccaatcaacatgctctacttcaatgacaagcagcagattatctacggcaagatccctggcatggtggtggatcgctgtggctgctcttaaggtgggggatagaggatgcctcccccacagaccctaccccaagacccctagccctgcccccatccccccaagccctagagctccctccactcttcccgcgaacatcacaccgttccccgaccaagccgtgtgcaatacaacagagggaggcaggtgggaattgagggtgaggggtttgggggaaaggggaagcaggggcatagtcagggtggggagtgtttgaagtttgcagatgagaaggtttgacaaaaagacagagagatgtagagacagtgatagagacagaggaacaaaaagagcagcagtgagaaggcaaagagagaggcagaagagacagacgaggcagagacaaaacactgagaaagagactgaaatggagtaataaatgaaagccccacaccaagcctcctttcttccactggcaaggtgaggggcttggtatagtttggggagatcccctgactattcagtaggagaagaaatcaaaaatccattcttttctccttctctccctccaacagtggccaggggaaggggaagtgagggcaggggcaaaaagatttgggaatttttatttatttatttattgtgacttttcatttttttggtatttggctttactggaataggagggcccctgcccactgtgccccgtttatcccttattccccaaaccctgctctccccaacacctactcacttaagcacttgtataaagcctccagggttgggaatgggagtaaagggcaagagggcggacacatgaagtttagtttctaacccatcatcaccctaactcaaccttttctgagccaaatggcttgaattgaagccagttgtcatggaaatagtaagaggttagggtttaagagctggggatgcgggggtgggagagagaaccctcaacatccaggatctatataatgagagctactttaaaccctcaggtccaccctcatgatgctgagttatttagccagagggtgcagcctgcttatgcccaaattccctcagccaagagagagaccaaagagcctctggaatggccctgctcccagcctctatcttcaggtcaattagagagagtatagagaccccagagtcccctgggtctggaaagcgttaggagaggtcaagaaaggagcagtaaggaggctgaaggttacagggcatttgaatccaaatcactgctctgggctagggaatagagccagcagaccaaggtgggaaggattctggaagggggacattttagtctcctaaccccaaagctcagggtggaagaggggagaacaaggaagcagagtgtataattattttttccttttatttttggaatctaacagtacctggcagcagggaggggaaagtacagtggggaaaagcatctgacaaggccagttagaacagaggatgggaaggatggagactcccgggcttggaaggctaggaagcaggcagagactggttgccatttcaagtcactagctaggcccattcattcctcccacaaccctgacccattctcctctggactcactgtgcctcagtttcttcccctcaatggaatgagaaatgacagcacccgccacagccaagagatgaattctgagcacttaccacgggcactttatggacataaaatacctctcgctgtgggacagataaccagggcaccagagtagtggtgaagagatgtgaggcttaagaggagtcacaggcttcagagtacaagttcccctctgcctcccagctggacagtgcctagaagccaaggagttgagaatctcctgatccacaccctatccttacttcaccaccaggcctcttggctccaggcaagagcttagaggatgtcaggagaggtgggggtaagaatcttcagcaaaactgtcactctaagtagagccagcagttacgggtctgataaaaacagtactgaactaaagtaaagcccaagctggtgagcaaaactggatggctcattcttcccaagagcatgactctcccccttggccagttggtggaaggggcaaaggtatgtgaccacccttgagaaggtgatgttggtgagctttaacatcttattcctattcttatagtgagaaagtgaaacaagatctttcagtagaggaatgggcagggctgttaggctcttcagcttgccttcacccatatagcagctatgctaaccccaagcctctctggccctgttcttcatccttccttctgccccaatcctgaaggacaagacacacccggccatcaacaccactcacatttccttggtggaaggaaaggaacagagaagtgaagaacagatacctccctccaaggtcaaatgcctcgtgatcttggcagagtagggattgggcaataagcatcaggtatcttccctctacagattctagagagctggggcattaaatatgggggacacttagaatacagctccttaaataccaccaaataaagacctttgtgtgtgtgtggtgggtggggggggggcaggggtctttctcttatgaacataaatctgtgagctgaagtctcattcccctgttcctccctacccccaaagaggcacagagtgaagggacttggggggcacagctcagcaacccagtgggagttagcaccccctcccaccttatgatgtgtgtggacctggccagtgcccctctgaacatatcattattagtgtaattatcatttattttgtgtatttgtcacattgtgtgcatgacagcctttgttaagggtgtctgaggagtatggagctgacaggggcattggaatgccaggaaagaacttcttcaactgagatcaaggcttcctggagggaaccactgcaaaaaggccatcaggcagttttcaagttatgtgacagagggcaaagacggccatagggtgctctgagttttgggatggtcacatgacacaatccagcacttgaacctgaaaaaaaaaataaaagcggtcaaagagtttagaattcagtgctgagctcttctccctaatcaagtgccacatttacaccttggagaaccggaggtgaagaggatctgagacaggaaacctcgtgttcaatgactaagaagatggggtcctggagcaagacagaaaacactaagggcatggtggtataaggtttgggacatgcaggccaaggaaggatggaaagaggacaggaaactgggggtacctagaacaacccctctctgaaaagcttgagccaaaacagtcccaaagacaacaagacccctctcccagcctccacagaatggaagatctaaaggttctcttgagatgatccagctagtatggaagatctaaaggttctcttgagatgatccagctagtgtcctattctcctgcagtccctgttcctaggtttcctcaacgaagtttgacaaaaatctaaaccaacatagccaacgaacttgccttgttacacaagagtggctaaaatagcatctcaaatattctttcagttcactgtaaaaatttttcccatgtacctagagcacaattccccaggaatatgagttgggaatggcaaaagaatattgcctgactcacatttttcaaaaataaggaaagctggctgggcgcagtggcttacatctgtaatcccagcactttggggggccgaggcgggcggatcatgcaaggtccggagttcgagaccatgctggccaacattgtgaaacctcatctctactaaaatacccaaaattagccgggcgtggtggcgtgcgcctgtaatcccagctacatggaaggctgaggcagaagaatcgcttgaacccaggtggcggaggttgcagtgagctgagatcgcaccactgcactctagcatggtgacagagtgagactcccatctccaaaaaaaaaaaaaaaaaaaaaaaaaggaaagcaggacccagtggtgtgctcctgtagttccagctattcaggaggctgtggcaggaggaccacttgaggccagagggtcaaggctgcagtgtgctataattgggcctgtaaatagccactgtactccaagctgagcaacacagtaagacactgtctctaaaaataattaaagtaaaataaaaataaggaaagctcctgtgacatcaacctgatccagaattggggacagcgctactgcgggttcaatgtactgccatgttttccctgtcttatcagttctatcagcacactgaccccactcgagaccaactacaagactaaggctggaagtggttgagtagcagaagtgttatgtattctatcttcccaagggaaccatatccacatctacccctaactttggcctgagctgaaaatgggttttctctccctgtggctcatttgtttcctatattgagagaacacccaaaaaaagactactcaagatgactttttacaagtcttttctttatcctaaaacatcctccaaccgaaggcatgggaagctatcctatactctgaccttgcctatattttaaatggcaggggccccaagctaagaatcagcaggcagtggcatctacagcttctggtctgtagtggcgtagaagcaggaaaatcaatgctccaaagcaacaatgtccagctttcctgccagtgagctgggcttgagggagtgaatgggactctttctgccttttctttttctcaaaatacgactgcattaactgggtgtatgcacacacaaacatgttcaaactagggcactcatacctagctagaacctactcagggaaagaaatatgtatttccacagtaccctgatcacccagtaaaagctaatatttattgaataattactatgcaaattatggtaagcaaattgtagtgtgaatacatgatatgagaatatcacttaattcacacagcaaccttcacaatggggttccttttggtacagtctgaaaagagaatgattatctgcgcagggtctcagagctagtgtggtagaataagaaattaaacctaagtagttgctaaacaatattacattctaatctatcctattgaaagtgatccgggaggtagaaacctaaatacaggaataacataagggaaagagataacaagaaagttagggacaccttggactcaaagaatctggaaagatgtgaaacctgtaattttaaatccctttggaagggaaaaacaagaaaagtctagatatggcaagagaaggggaggttaaattttggggggattccaataatcagaaataagtggcattgccagaggccctcatataagagaacagcaaaaaagttatcctcccttaagttcctccctcactcctcatatcagacacagcaagagaactcagctcaacaccaagaagtcctgcccttattcacaccttccttcctatagccctcatcctcacagaagcttctagcctctatcttcagcagttcttaagaggtggggtggggggctgggcagtttagagtgagagtggaaaaaaagaataatcctagagaaccataaaaaagtacagatttacagctgaggaagctagttctccccacagcttttatagactccctcattaagagcttccaggtatgcagagaatgtcacagcttcaggaattggaatcagttaaccacatctggatgctggatcaactatagtagggaaacggggagaggaaggaagggtactaagatctcaggtaaacaattacaagcctcaatgtctgttccatctccaaacggaattactattttaaaactgaattgggaaaaaggcatcctgaactattcatgctcaaagagtatgtggagaatgactataatgagataggaaggggaggacttcatctggcttggaggttagagacttctgaccaacataggaacagctgctgaaatgggatgaaagaggttaataagaaaaaaaaaaaaatcctcacaaattggaaaacactgttcaaagatctaggggaagtaagatgagtgaggagaataattaggcttcaagaagagaatcctggcaagtaaggctgaatatctttctggaaggttatagaggataaagagacgaagaaaacttccaaaagatccactgttccacttcataatcagcatctgctctattccctcatgtatttttctctttttaaaaccatattcaggaagaaaccattagtgaatctataatctctcaagttacaaatcagatctattctgttttcagatgaaggcagagtagagagaggaaaagctagccccaagatcagagcctgaggtaaagaaaaggaaggcagacagaaaagagggaaaagggaaggtcattccaattttaaggtttatttggttgaagaggtgtcaaaaatttaaccagcattcccttttgttcacttctccaaagtctcagaatggggcaaacttcacaacaaatgggcagcagtttttggatctgctctccaaggcacaatttttctaaattatctaaactttaggtccctgctttcctcaccaaccagagactttggagaaataaagagatatcttgacattagaaaggtgatcaaactattaccatttcattaagcacaaaaccaggcaggttttagtagaaataaggataaaggattacaccacagcaacatgggacctgatcatagtaccaaagtcttcaggtaaggtgtcaggctcctaagtcttattaccaaaaatagctcaaacaaaaaccgagcttatataaagattaagaggagaaattctgcaataacatatccaaaaagattaagcaggtttcagatctacatgaacttgaagcctccagttccactgcttatgttcccaatgatttagctaacaatgcgtaacagctctgacatcctctgtcatgctttgattctgcatacaaaatttcttctgtctctgagggatatccagcccatctcccttcctgaactgactgaccaacatagtatcgtatcacatcacccttgaaatcagggcccttttcctttaatgtgggaccctggactccattttatccaagaaaaagtctgcattattagctaataacagaaggctactaatcactgcccttgtatttatatcctttgcaacacctaaaacctcccatgttctgttttatttcagtgggtcactacaagctgctggagcaaagacttggtgggtgggtaacttaacctcttcacagaggataaaaaatgcttgtgagtatgacagaagggaataaacaggcttaaagggtaaactcagtccttttccttgtcttctcttctaagggataaaggtattatggccaattctctataatatttgcccctgaagctccccttatctggtctaatctagctccaataaatcaaaggagcacctaataaaacacattgttctctttt

SEQ ID NO: 8313 - DNA, 1258 bp, Homo sapiens
  ENST00000546799
ccgcggcggcggcggcggcggcggcggcggcggcagcggcgggggtcgggggggagcgctccagccggccagccccgtccgtggcgcccgagccggacggctgccccgtgtgcgtttggcggcagcacagccgcgagctgcgcctagagagcatcaagtcgcagatcttgagcaaactgcggctcaaggaggcgcccaacatcagccgcgaggtggtgaagcagctgctgcccaaggcgccgccgctgcagcagatcctggacctacacgacttccagggcgacgcgctgcagcccgaggacttcctggaggaggacgagtaccacgccaccaccgagaccgtcattagcatggcccaggagacggacccagcagtacagacagatggcagccctctctgctgccattttcacttcagccccaaggtgatgttcacaaaggtactgaaggcccagctgtgggtgtacctacggcctgtaccccgcccagccacagtctacctgcagatcttgcgactaaaacccctaactggggaagggaccgcagggggagggggcggaggccggcgtcacatccgtatccgctcactgaagattgagctgcactcacgctcaggccattggcagagcatcgacttcaagcaagtgctacacagctggttccgccagccacagagcaactggggcatcgagatcaacgcctttgatcccagtggcacagacctggctgtcacctccctggggccgggagccgaggggctgcatccattcatggagcttcgagtcctagagaacacaaaacgttcccggcggaacctgggtctggactgcgacgagcactcaagcgagtcccgctgctgccgatatcccctcacagtggactttgaggctttcggctgggactggatcatcgcacctaagcgctacaaggccaactactgctccggccagtgcgagtacatgttcatgcaaaaatatccgcatacccatttggtgcagcaggccaatccaagaggctctgctgggccctgttgtacccccaccaagatgtccccaatcaacatgctctacttcaatgacaagcagcagattatctacggcaagatccctggcatggtggtggatcgctgtggctgctcttaagtgggtcactacaagctgctggagcaaagacttggtgggtgggtaacttaacctcttcacagaggataaaaaatgcttgtgagtatgacagaagggaataaacaggcttaaagggt

SEQ ID NO: 8314 - DNA, 2502 bp, Homo sapiens
  ENST00000376217
aaagggtgaatcatgtttaagaaggtcaacaggattgagcacaagaggaataagacagaaaaaccaaaaaagcttaatccatggattccacgcatcttcaaccacaaatgctttgtcaccttccttactggctgctatagttgcctctggaaattcagacaatgggaaaaaactaaagttggattttgttgctgcacttggaaagagcaattattttgccgtgcctggtaatttcatttgtcttgtctctgatgttgctgttcctgtggatagaaacatccagtgaatactttaactttgactgggtcacttttctaggaacaggatactggtttttctggtctatttttattctgagtttagctaggatcctgactgcctactcttcattgctgttgttacttggatttttgttgctttgggaaaggattgaactatacctgcacttgtgtcataagatcctgattctgctagtgattcttctgtgtgtcattttaatgttcattatatgcaaattctggaaagaaaggtggctggtagctgggctgtcaatgcagatctttgctccctacgtgcacctggtcagcataactgtgatggttatccttttctggcctgtggccttctacgtggcatgtttggaaagagaagttagaatgagaagatacaggatgacacattctgagaaaaaaagactcaagcaatgtaatgtaatcacaaggttaagaggtctacaagtgcctgttggattaccctttcttcttatccttttaggtctctatttgatgccactggggatttattctccctgcattcaggagaaggagaatttggggcccaagccaaccatctttggacatagaggtgcacccatgttggggcctgagaataccatgatgtcctttgagaaagctgttgaacatggagcccatggattggagactgatatacacttaagttatgatcatgtgcctttcctcatgcatgactttgacctgaaaagaacaaccaatattggggaagttcagccagaatctgcctgcgagaaccctgccttcttcaactgggatttcctatcgactctgaatgcaggcaaatggtttgtaaaaccagagctcaggccattttacaatatgaaacctctatcagaggcagataaagaaagagcaagaaatcagtcaattccaacactagctgatttattgacacttgcagagaaggaaagaaaatttgtgatatttgatcttcatcgccctccaccaaaacatcctctcagacacacatttgtccgccaagtagtaagcgtgatccttgcctctaaaatcgagcaacatctgattttttggttgccagctcatgataggcaatacgtcaggtccgtggctcctggttttcagcatgtgggccgtttagtatccattgaaacccttgctaaaaacaatatcagtataataaatgttgactacaagaagttgttccctaatgggttaagagattataaagcagctaacatccatatcaacgtatacaccgtcaatgagccttggcttttctcactggcctggtgctccaggattaactcagtgaccacagacaacattgggctcctgagtcagcttgatcaccctcacttcttcatgacaccaaagttctatgtgttcatgtggctccttgcagatatcatttctgtgctttttattgttgccatattttgttttcactggcggagagagactgaaaaagaaaaattgtttgaaacctccagcactcgcacagatactcagagtggaaatttgcacatagccatgaaacctcctgtccgagttgtggaaggtccttggactctagcagccctctacccggctctacccaagagtggaaaggaacaccaaggccatttcaattttgcagcaccatccaagaaactactacctatcaagaatgctgtcacacctttgaagcctggcaagcatgagattcaaccaccgatgcccaccgtggtctttgaactcacccaagcacccaccaggcaggctacaagtgaggctacctttcaaactacattgcccaccctgaaggtggataagccaaccatgccctccatagaggtcccctatccttaaataagagacctctaagagatccccatggctgaatactccaaataatcctatgtcacaatatattccattgcatctgacatagccttctgtgtttccaaagaagaattagccacatctcccctgcttcttcctctctctgcctaagggtggtgatggtggggagtggttgataaaggcacacagaagggccacggaggctctcaggggaaccattgtgctctcgctatcaagaatgcatctcaaggggctaggcaaggggaaaactgctgtgtgtggtcttggaactggttgctgtcaggtttatctcatcctaacacctccataatattttctgctaaaggagtgactgtgcatataagtaaaggcaacctctcaggaa

SEQ ID NO: 8315 - DNA, 2533 bp, Homo sapiens
  ENST00000315938
aaagggtgaatcatgtttaagaaggtcaacaggattgagcacaagaggaataagacagaaaaaccaaaaaagcttaatccatggattccacgcatcttcaaccacaaatgctttgtcaccttccttactggctgctatagttgcctctggaaattcagacaatgggaaaaaactaaagttggattttgttgctgcacttggaaagagcaattattttgccgtgcctggtaatttcatttgtcttgtctctgatgttgctgttcctgtggatagaaacatccagtgaatactttaactttgactgggtcacttttctaggaacaggatactggtttttctggtctatttttattctgagtttagctaggatcctgactgcctactcttcattgctgttgttacttggatttttgttgctttgggaaaggattgaactatacctgcacttgtgtcataagatcctgattctgctagtgattcttctgtgtgtcattttaatgttcattatatgcaaattctggaaagaaaggtggctggtagctgggctgtcaatgcagatctttgctccctacgtgcacctggtcagcataactgtgatggttatccttttctggcctgtggccttctacgtggcatgtttggaaagagaagttagaatgagaagatacaggatgacacattctgagaaaaaaagactcaagcaatgtaatgtaatcacaaggttaagaggtctacaagtgcctgttggattaccctttcttcttatccttttaggtctctatttgatgccactggggatttattctccctgcattcaggagaaggagaatttggggcccaagccaaccatctttggacatagaggtgcacccatgttggggcctgagaataccatgatgtcctttgagaaagctgttgaacatggagcccatggattggagactgatatacacttaagttatgatcatgtgcctttcctcatgcatgactttgacctgaaaagaacaaccaatattggggaagttcagccagaatctgcctgcgagaaccctgccttcttcaactgggatttcctatcgactctgaatgcaggcaaatggtttgtaaaaccagagctcaggccattttacaatatgaaacctctatcagaggcagataaagaaagagcaagaaatcagtcaattccaacactagctgatttattgacacttgcagagaaggaaagaaaatttgtgatatttgatcttcatcgccctccaccaaaacatcctctcagacacacatttgtccgccaagtagtaagcgtgatccttgcctctaaaatcgagcaacatctgattttttggttgccagctcatgataggcaatacgtcaggtccgtggctcctggttttcagcatgtgggccgtttagtatccattgaaacccttgctaaaaacaatatcagtataataaatgttgactacaagaagttgttccctaatgggttaagagattataaagcagctaacatccatatcaacgtatacaccgtcaatgagccttggcttttctcactggcctggtgctccaggattaactcagtgaccacagacaacattgggctcctgagtcagcttgatcaccctcacttcttcatgacaccaaagttctatgtgttcatgtggctccttgcagatatcatttctgtgctttttattgttgccatattttgttttcactggcggagagagactgaaaaagaaaaattgtttgaaacctccagcactcgcacagatactcagagtggaagtaagaatgaggaagatagatagatagatagatttgcacatagccatgaaacctcctgtccgagttgtggaaggtccttggactctagcagccctctacccggctctacccaagagtggaaaggaacaccaaggccatttcaattttgcagcaccatccaagaaactactacctatcaagaatgctgtcacacctttgaagcctggcaagcatgagattcaaccaccgatgcccaccgtggtctttgaactcacccaagcacccaccaggcaggctacaagtgaggctacctttcaaactacattgcccaccctgaaggtggataagccaaccatgccctccatagaggtcccctatccttaaataagagacctctaagagatccccatggctgaatactccaaataatcctatgtcacaatatattccattgcatctgacatagccttctgtgtttccaaagaagaattagccacatctcccctgcttcttcctctctctgcctaagggtggtgatggtggggagtggttgataaaggcacacagaagggccacggaggctctcaggggaaccattgtgctctcgctatcaagaatgcatctcaaggggctaggcaaggggaaaactgctgtgtgtggtcttggaactggttgctgtcaggtttatctcatcctaacacctccataatattttctgctaaaggagtgactgtgcatataagtaaaggcaacctctcaggaa

SEQ ID NO: 8316 - DNA, 518 bp, Homo sapiens
  ENST00000532907
ctccggtctgcagctcccagcgtgattgacgcagaagacgggtgatttctgcatttccaactgagatactcagagtggaagtaagaatgaggaagatagatagatagatagatttgcacatagccatgaaacctcctgtccgagttgtggaaggtccttggactctagcagccctctacccggctctacccaagagtggaaaggaacaccaaggccatttcaattttgcagcaccatccaagaaactactacctatcaagaatgctgtcacacctttgaagcctggcaagcatgagattcaaccaccgatgcccaccgtggtctttgaactcacccaagcacccaccaggcaggctacaagtgaggctacctttcaaactacattgcccaccctgaaggtggataagccaaccatgccctccatagaggtcccctatccttaaataagagacctctaagagatccccatggctgaatactccaaataatcctatgtcacaatatattccattgcatct

SEQ ID NO: 8317 - DNA, 546 bp, Homo sapiens
  ENST00000532155
ccttccagccaggcgtccatcttaagagacgctggtctcctcaggcgtgaagattggatttgggttgggactgggaagtctcgttacttggatttttgttgctttgggaaaggattgaactatacctgcacttgtgtcataagatcctgattctgctagtgattcttctgtgtgtcattttaatgttcattatatgcaaattctggaaagaaaggtggctggtagctgggctgtcaatgcagatctttgctccctacgtgcacctggtcagcataactgtgatggttatccttttctggcctgtggccttctacgtggcatgtttggaaagagaaggtatgtcacatagggcagaaccctgcctatttcttcagctctggctttagcttgcatactccactcaggaaaacagaagcttgggaactagccacccctatgcctcgttgaaattcatttagcttgttactcaggcatgctcctgtgctttcactcactaccctgttatagtggccaatggcctgtcatagtatttctgtggccaaacag

SEQ ID NO: 8318 - DNA, 574 bp, Homo sapiens
  ENST00000527489
cctcaggcgtgaagattggatttgggttgggactgggaagtctcgctaaagggtgaatcatgtttaagaaggtcaacaggattgagcacaagaggaataagacagaaaaaccaaaaaagcttaatccatggattccacgcatcttcaaccacaaatgctttgtcaccttccttactggctgctatagttgcctctggaaattcagacaatgggaaaaaactaaagttggattttgttgctgcacttgggtacagactgataaggagctggaccacattttctcagatgcggggagcataggctgactgctgggccccatgagggctctttatggtctccaggactggggatgctagggctccatttcttccataaaaagcaattattttgccgtgcctggtaatttcatttgtcttgtctctgatgttgctgttcctgtggatagaaacatccagtgaatactttaactttgactgttacttggatttttgttgctttgggaaaggattgaactatacctgcacttgtgtcataagatcctgattctgctagtgattcttctgtgtgtcatttt

SEQ ID NO: 8319 - DNA, 560 bp, Homo sapiens
  ENST00000534245
ttaagagacgctggtctcctcaggcgtgaagattggatttgggttgggactgggaagtctcgctaaagggtgaatcatgtttaagaaggtcaacaggattgagcacaagaggaataagacagaaaaaccaaaaaagcttaatccatggattccacgcatcttcaaccacaaatgctttgtcaccttccttactggctgctatagttgcctctggaaattcagacaatgggaaaaaactaaagttggattttgttgctgcacttgggtacagactgataaggagctggaccacattttctcagatgcggggagcataggctgactgctgggccccatgagggctctttatggtctccaggactggggatgctagggctccatttcttccataaaagtattgcaccaatgttaaacttactgaaacatgtacttgctttcttcattttctttccttcacttcatttttcacttttattctttacttttccttactacctcttttatgtttattcattaattcacttttgcatttattcattcagtgaatcttgaagaaaaag

SEQ ID NO: 8320 - DNA, 4150 bp, Homo sapiens
  ENST00000526177
tcacagctctggaaaggtccctggagaggatgtggaaagatccccagtaggtagcagagccaggattcgactgaagaccgtgattcaagtgaggctcttaaccctgggccagctgtctgccatttggactgcaaaacccagaggccagatacccctaagaggccagctgttgcacctctgcaaggcggggttccacctcctctcgggtcccggcacctaggccagactcatcgaatgaatgaaagactctgttgtatcccctgtacccaccatggctatcacaagccacagtcccatgaagacagagaacccaaggccactttctcagaggaggacggtgatctgtctctgggcctctagggtgggattcatccttctcagtcagatttcaggagcgatggtggttgcgtttttgggtgtcagtgctattgctataacttaatgatgcaaggtagggaagtcccacagacactgaacatgcagtgatgctgctgagtgtgttgattagcaccaaagcaactgtggaactcagagataataacatttttaattgtattagggtttggggaatcagttttattgcaagtcgtttccattaataggtattgtgatgagatgctcctggaaaccatccttaactcactgtgtgcagggccacctcccacgatggccacaagggggagctgcgcgccgggggcagccgggagaaggggcctgagtgccgagggcggggttctcaggggttcggaggcgcagctgggcctcccagagactgcgcagcctctctgacaccagcgtgctgtctgtccgagaaagcgcacacccccttaccccctgagatgggcagaaggtgttcgtttctggttctgccccttcaaagctccgtgacccagccagctgttcctctccccgaacctcgcttcccgtgtgtgagatgaggatgctcgtgcctccgcggaaccaacctggggaccacgcgaagcgcccccacaggcccaggctgatgggctggaatgaaaagcctccaaagggaaacttcatcccaggcgagactcagcattccccgccggcgagtgaaggtccctgggtagggagcggagatgctggccaccgccccaccctcatcgtctagaaatgccactgtccctgctcggcatcagagggccctggccgctgctgcctctgggaaaggttgcctcgggagaaagggggtgaaggccctgccagcagctagaacggctccagggaggcagggcggccggcagtgctgtgggagaaggacaggcctttggagggagatgggagacgagtctggagaaactagggggacggaggtggcggctttgactgacccttccagagactgggatctgcgggaggctttggaggagagccacaacctgggcttcggggaggcacgcctgggggtgtggaggggggtgggtggagtgagatccacggctaggggcgaggggctgggggccgaggagccgaaaacctctgccgagcttcacgtggttaaagatttcaggtcttacctgtcaccagagatctctgtcccgtagaggtgccacctcatcctccatgagagctgtgctttgctttcttctggaggctgcaaggaggatggcccccatcacggcggacctagatgctgggagtccgggagagggcaggccgtggagatggggcaggtggcgatgtgtttcaccacccactcccgcctgaagtgccactgtgagcccagcccagggtgccaggctgggctgcactccaggctcctgcagcagacccagttcctcagcctccttcccctgaggcctgggcatggcctggacaaatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttga

SEQ ID NO: 8321 - DNA, 3211 bp, Homo sapiens
  ENST00000527820
ctttgtgtgtcctgctcacattgtctccagggcctcggacagggcctggtacagaacatatgactgagtttctggagtcccacaggccagcgttggagtcctgacacctcagtatagctgtgcacctctgggcaaatagtttctctgctctgagccccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaaggcctcctctgggcttccactatcccctctgtgagggagtttcttctcctggctgcaaagctggcatttgaaagaactgcaccagctggcaccccgggtggggctggcacatgctgtggtcaccttctggggccatgcctggctctcagcaggctgccctgagcacactgcactgctcttctgtcctcgcctgactcccctgcctcagtggcagcagcccccagcccaggacctgcacagaggaggcgtctgtcagcgacccaacctgagccccagagaggagcactgggtaccacacagccccaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttga

SEQ ID NO: 8322 - DNA, 2441 bp, Homo sapiens
  ENST00000533784
tggacaagacacctccaggagcccagctcacagccaccggtaccttcttccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttga

SEQ ID NO: 8323 - DNA, 3222 bp, Homo sapiens
  ENST00000529721
ggctgctttagaagaacaagctggtttggcagctacctcagagaagcaggaccctgggcagcgtgaaagggcctctgcccccagggtggctgggctttggatcctggatccgtgggtcctggaggggcaggagtggttcaggaaacagctctcccagtgaagtgatatcactgcctctgtggacaagacacctccaggagcccagctcacagccaccggtaccttcttccagggctgctgttatagtttctgcatggaaagcacttggaacaatgcctggctgttcccctctttggccctctcagggccctaggagcctttgtgtgtcctgctcacattgtctccagggcctcggacagggcctggtacagaacatatgactgagtttctggagtcccacaggccagcgttggagtcctgacacctcagtatagctgtgcacctctgggcaaatagtttctctgctctgagccccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttga

SEQ ID NO: 8324 - DNA, 3523 bp, Homo sapiens
  ENST00000336898
cggggatgacagcggaggtggcagcggcgcggcgctgagcgagcggcgagggagcaggggaagaggaggaagtggagccgcggccgggagctcgggagtcggccgccgcgccgaggttcgccccgttttgcagagagagccgagtcgggacctggaaagacttccccgcggggctccggccgccgcgcctccccgccggcgcctgccctgccctgcccgtcccagccccgcggttcggggcgtgcggccgggacgcgcggagccccggccctgacccgctgcgccgggacgggacgctcctaacgccgccgtaccggtccgtggttgcagggtcgctccgcgcctttccgtcagtgagggtcggaaccccagctccagggctagcgcagtgtggccccaggccctcgcctccggtgcacgggaccccggacccccccagcctctggcttcacgagaccccaaccttcagttggaacagcttggaacagcgcgagcgcccgggaagccctggccgggtcgtgcgctcggtgaggggtcctaggcgggcaggacagtcggaccgaaccgccgggctggtgccgcgagcccaggctgtcaccttcgtcccgcctcaggtgaggggttcagcgcctgccccgaagataacacaggggtccccttctgtcccggcggcctgcgagagccaaggctgcagctctcccagtgaagtgatatcactgcctctgtggacaagacacctccaggagcccagctcacagccaccggtaccttcttccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttga

SEQ ID NO: 8325 - DNA, 2424 bp, Homo sapiens
  ENST00000533805
cggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatggcatcaggagaaccctccaggagagctgggaggcagctcagagcccactgtgacagtgagtacggctgaaccgacgtgagttggagaaagacgaagggatcaaagtcagcgccgcattctgccaccagtgcactccatagccctgcaggagagcttcgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttg

SEQ ID NO: 8326 - DNA, 2633 bp, Homo sapiens
  ENST00000531759
ctttacattctatctctaacacccatccctgctttgctccccgcaacacacagccttttcctcattcccctcagaggaccccacagtggctgagcttcctgttctggatatgcctggccgagagaccctggcctgacactgtccttctgggtttcaacatgaatttccaggatgggacctagagcttagggacccacgtctccctccgtctagtgccttagcccctcctgggtcaggcagcttcaccaatcagcttctaggaggagatgctgtccctggctatgggacattccttgagtcattcctgtgtccgcccagttgaccaacatccacatacactggttgctgatgctgtctgcagcaggagttgggccttctcacatggagccccagggtgctggggaggccaccccatggtgattcagtggctggcacagacacgctgggtctgctcagacacagccagggcagtgtcattgtctcctggggatcaggagaggcctggtggaggaaggtaccctgggggacaaggccgggggaggatactctttccctgtgggccttattcttccattcattcactcaacaagtacaggtcaggctcccgggacacggcaggcactgatggtactggggcacagcgatgaacagagagagatttgctcactgccctcaatgattcatagggcagccagcctcgccagggtgtccgtgccaccccccgcctcctgctttccccttgtctgcctgctctgttcatccatccatccgcctgtccatctgtctgtccacttctgctgcgctgaccccatctagtaactcacagttggtttcttgtggagtcttggctctctccatcccccaagcagggttcagtccctgaggcagttgggttcttgttcccaagttgatcaccccctcctcctggtggggacaggggtgagagtccagtgatccttctgcctagatcccaggaaaggtctaagttcagaggccagggactggggctagttcagaggaatgacaatagtgaagacagtggcctgggctgggcacagaaacctgagtcctttccacttagtgcctggtcccttcatgccctgtgcatgctccacctcccagcccactcttgagtaattttacccccaccttgcacctgtctcagccatcagagggattcatgctctgacctccctccgcattaggactgccaggacagagcagcagttggccccactccaagtcactctaacccccttgccttgggaacctgtgcagaccagctctgggcaaagccccctaccacctggccccacccccctgctttccttccctccctctcaaggggtctccccaatggcttcacttagtctggtcatgatggtggagctataagagacatcagctgggactccctgagattggtgtgtgccccagcttaggtcaacagagtcgtgcctactaagctcctcctgctcccaaatctgtcccattcaaagagagccaggtgcattactggggacacctgagacagaactaaccaaccctagtcctgggccagggctgctgactggcggctctggaggtaagagggaggccagggagccctggccgagagtcagtaggctctgattcaagccccaactctgccctctctgggcctatttccccattgtacagtgggacaagagtcctgctggtctcttgggccacatccagagaggctctggaagtaggcagggtctctgctccaagggagggctgaggagagacctgatgcccacggggccatctctgcaggtggcgcctgggtggcatacggagctacaaccctgagcagatcatgctgagtgctgcggtgcgccggaccagccgggacgtcagcatcatgaaggagaagcttattttctcagcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccc

SEQ ID NO: 8327 - DNA, 527 bp, Homo sapiens
  ENST00000534322
gcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaactatcacttgatcaggtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgt

SEQ ID NO: 8328 - DNA, 449 bp, Homo sapiens
  ENST00000531561
ctgaccccagcagactctggcagcccaggggtctccacgcttggttgccagaagggtatgtgggggcccccaaagggctgatgatgcagccatgtgtgtgtccctgtccctgccagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccag

SEQ ID NO: 8329 - DNA, 1000 bp, Homo sapiens
  ENST00000527322
gtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaaggtctggctgcacctgatcccaatcttaggcatggaaaacaccagcagggactgcaaggagtgagaggtgcaagggtggccatcagcttcgagacccccactctcagagctttcgcgacctccacccaagctgcttagtggcctcctaggctcctgccactgctgccagactcatggttgtcactgcttgttctgggtccatttccctcactagaaaaggttgacagggatgagagcagtgaatagaattcttaactctgtaaaactctagagaggggttggctctctgatctgaaatgctctagaaggagaaatgctgtgggtctgggagcgattccaagcaagccgtcctccgtcctcttggtaagcaggg

SEQ ID NO: 8330 - DNA, 603 bp, Homo sapiens
  ENST00000533911
cggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaaggtctggctgcacctgatcccaatcttaggcatggaaaacaccagcagggactgcaaggagtgagaggtgcaag

SEQ ID NO: 8331 - DNA, 724 bp, Homo sapiens
  ENST00000528031
ccagcgttggagtcctgacacctcagtatagctgtgcacctctgggcaaatagtttctctgctctgagccccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaaggtaagggccgcctcggccggggctgggagagagcaagggaagctggaggcagcagcagcagaggaagggcctggccaccatgtccctcccctggatcaccgttagaattgttctcatagctaaggctgagcactcactatgcgccaagcacttttctcacaacctcacccgtcttcattcacttaacccttacagcaaccttgtgatgtaggtac

SEQ ID NO: 8332 - DNA, 825 bp, Homo sapiens
  ENST00000532435
ttggaacagcgcgagcgcccgggaagccctggccgggtcgtgcgctcggtgaggggtcctaggcgggcaggacagtcggaccgaaccgccgggctggtgccgcgagcccaggctgtcaccttcgtcccgcctcaggtgaggggttcagcgcctgccccgaagataacacaggggtccccttctgtcccggcggcctgcgagagccaaggctgcagctctcccagtgaagtgatatcactgcctctgtggacaagacacctccaggagcccagctcacagccaccggtaccttcttccagggctgctgttatagtttctgcatggaaagcacttggaacaatgcctggctgttcccctctttggccctctcagggccctaggagcctttgtgtgtcctgctcacattgtctccagggcctcggacagggcctggtacagaacatatgactgagtttctggagtcccacaggccagcgttggagtcctgacacctcagtatagctgtgcacctctgggcaaatagtttctctgctctgagccccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactg

SEQ ID NO: 8333 - DNA, 1201 bp, Homo sapiens
  ENST00000529095
gaggggtcctaggcgggcaggacagtcggaccgaaccgccgggctggtgccgcgagcccaggctgtcaccttcgtcccgcctcaggtgaggggttcagcgcctgccccgaagataacacaggggtccccttctgtcccggcggcctgcgagagccaaggctgcaggctggagtgcaatggcgcgatcttcactcactgcagcctccgcctcccaggttcaagcgattctcctgcctcagcctcccaagtagctgggattacagtcccccatttatgcttcctgttgggtgtacctctctgaaagccagcagcatggagcccattacattccacagagggcctcaggtaccccctctgggaggcctgcagcctgtcacagcatgctgagccaaagccacctgcccaggttcccaaatcttggaagcactggatcatggaaccatagaatctcggtgatatgaaatccagacttggaggaggcctaaggggtcacaatccaaaccttcatccagcccaggcagcccctctgcaggctccgtgaacactctggcaactggggagtcatctgtagccccctcagcttccactactaagccatctgctccagggcactgggggatcctgcaggggttttctgcttgaagagccacttcctgtttggggccgagcacttccttcagctctcccagtgaagtgatatcactgcctctgtggacaagacacctccaggagcccagctcacagccaccggtaccttcttccagttatacagatgctgcagctggcattgacgtggaaggtgatagaaacgtgaacaggcccgccctgtggggctgcaaccatggagagtctggactttagagtcaacagccccgggttcaaatcctccctcctccatgattagctgtttggccttgggtgaattacctaacctcttgggtgcgggtgcacacgtgtgtgtgtgtgtgtgtgtgtgtgtgtgtgtgtgtgtgtgtatttaatacactttttcaaaagcagttttaggtttacagtaaaattgattggaaagtacggagagtttccatataccctcctctgcctttctcctccccatagtctggcttattctttacatcttatattaatatggtacatttattacaactgatgaactaatattggttaattatgattgactaaagtccatgtttgcgctata

SEQ ID NO: 8334 - DNA, 239 bp, Homo sapiens
  ENST00000524785
caggggtccccttctgtcccggcggcctgcgagagccaaggctgcagtcccccatttatgcttcctgttgggtgtacctctctgaaagccagcagcatggagcccattacattccacagaggtcagttcccagggccccaaacaaggtagagagtggctctggagaagcaaaccaaagacacttcctcactctgtccatcaaaagcccgggagtccactgaatacactgtccttaggac

SEQ ID NO: 8335 - DNA, 366 bp, Homo sapiens
  ENST00000531441
cgagcggcgagggagcaggggaagaggaggaagtggagccgcggccgggagctcgggagtcggccgccgcgccgagggtcgctccgcgcctttccgtcagtgagggtcggaaccccagctccagggctagcgcagtgtggccccaggccctcgcctccggtgcacgggaccccggacccccccagcctctggcttcacgagaccccaaccttcagttggaacagcttggaacagcgcgagcgcccgggaagccctggccgggtcgtgcgctcggtgaggggtcctaggcgggcaggacagtcggaccgaaccgccgggctggtgccgcgagcccaggctgtcaccttcgtcccgcctcaggtgagg

SEQ ID NO: 8336 - DNA, 3106 bp, Homo sapiens
  ENST00000443276
tggtgcctgactcctcacccttcccctgcctcactgccctgtgcttcctcctgcaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaaggcctcctctgggcttccactatcccctctgtgagggagtttcttctcctggctgcaaagctggcatttgaaagaactgcaccagctggcaccccgggtggggctggcacatgctgtggtcaccttctggggccatgcctggctctcagcaggctgccctgagcacactgcactgctcttctgtcctcgcctgactcccctgcctcagtggcagcagcccccagcccaggacctgcacagaggaggcgtctgtcagcgacccaacctgagccccagagaggagcactgggtaccacacagccccaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttg

SEQ ID NO: 8337 - DNA, 2103 bp, Homo sapiens
  ENST00000396194
tggttataaaccgcccggccgcggcggctgcaggcggcgggcaaggacggcgggcacagcgcagcactccccgctcgttggcccgggtatcccagcgcggacccacgcgatacgctgacgccccgacgccgatccggccgagccaagactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggagaagatacatatgaacgaaccctgatggttgatggggaaagtgcaacgattatactcctggatatgtgggaaaataagggggaaaatgaatggctccatgaccactgcatgcaggtcggggacgcatacctgattgtctactcaatcacagaccgagcgagcttcgagaaggcatctgagctgcgaatccagctccgcagggcccggcagacagaggacattcccataattttggttggcaacaaaagtgacttagtgcggtgccgagaagtgtctgtatcagaagggagagcctgtgcagtggtgtttgactgcaagttcatcgagacctctgcagctgtccagcacaacgtgaaggagctgtttgagggcattgtgcgacaggtgcgccttcggcgggacagcaaggagaagaatgaacggcggctggcctaccagaaaaggaaggagagcatgcccaggaaagccaggcgcttctggggcaagatcgtggccaaaaacaacaagaatatggccttcaagctcaagtccaaatcctgccatgacctctctgtactctaggaacccagggtcacccagatgtccctttgatggccgttgttgaaggccattgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagagaagtaaagcttacaaagaatgcctagaacaagaacttttcatcattaaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcaaactgtgaaaagaaatgatgtggaccttgctggaaacaaaggcttagcaaacaatttttgttcaatgcccaccaagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaatttttataaaacatatagcataaaaacttccagtactttggttgacccttgtatgtcacagctctgctctatttattattattttgcaaaataaccattttaacatttgataaagcatatttatgaacatatttcttaataagaaaaatatccattttattaccattttctatctttttcaaaatatgcaagtttttacctatatgtcttataataaaagaaataaaatatttgaaaaaa

SEQ ID NO: 8338 - DNA, 2208 bp, Homo sapiens
  ENST00000297596
ataaaccgcccggccgcggcggctgcaggcggcgggcaaggacggcgggcacagcgcagcactccccgctcgttggcccgggtatcccagcgcggacccacgcgatacgctgacgccccgacgccgatccggccgagccaagtaagggggacggcccgagacggagaagggagagagtgggagtttcccagcccgcagaactttcgaagttgagaaaagaacccctggaacgtgcgctcagcactgggattttctggactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggagaagatacatatgaacgaaccctgatggttgatggggaaagtgcaacgattatactcctggatatgtgggaaaataagggggaaaatgaatggctccatgaccactgcatgcaggtcggggacgcatacctgattgtctactcaatcacagaccgagcgagcttcgagaaggcatctgagctgcgaatccagctccgcagggcccggcagacagaggacattcccataattttggttggcaacaaaagtgacttagtgcggtgccgagaagtgtctgtatcagaagggagagcctgtgcagtggtgtttgactgcaagttcatcgagacctctgcagctgtccagcacaacgtgaaggagctgtttgagggcattgtgcgacaggtgcgccttcggcgggacagcaaggagaagaatgaacggcggctggcctaccagaaaaggaaggagagcatgcccaggaaagccaggcgcttctggggcaagatcgtggccaaaaacaacaagaatatggccttcaagctcaagtccaaatcctgccatgacctctctgtactctaggaacccagggtcacccagatgtccctttgatggccgttgttgaaggccattgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagagaagtaaagcttacaaagaatgcctagaacaagaacttttcatcattaaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcaaactgtgaaaagaaatgatgtggaccttgctggaaacaaaggcttagcaaacaatttttgttcaatgcccaccaagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaatttttataaaacatatagcataaaaacttccagtactttggttgacccttgtatgtcacagctctgctctatttattattattttgcaaaataaccattttaacatttgataaagcatatttatgaacatatttcttaataagaaaaatatccattttattaccattttctatctttttcaaaatatgcaagtttttacctatatgtcttataataaaagaaataaaatatttga

SEQ ID NO: 8339 - DNA, 838 bp, Homo sapiens
  ENST00000523660
ataaaccgcccggccgcggcggctgcaggcggcgggcaaggacggcgggcacagcgcagcactccccgctcgttggcccgggtatcccagcgcggacccacgcgatacgctgacgccccgacgccgatccggccgagccaagactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggaggtaggtgtcccagccccagtgggcttctttccaccaggggtggcccaggaagaaagagtgagggtgggtgacttatttacccacagagttgggagctgaagttaggcattttggacaattgatgggggagctgagtctctagaaaagcccaagcacaggctttcgggcaagaaaatgaaaatgcttgtagacaggaccaaaatctgttgatcctgggccagaaagggaattcttcagattccaattctaaatgggttggggaaggctgattagagagggcagagccagagggtcagcgccccacttgacttctgctgactctgacttgaacattcttcccggaactcagtatagaca

SEQ ID NO: 8340 - DNA, 740 bp, Homo sapiens
  ENST00000521817
aggcggcgggcaaggacggcgggcacagcgcagcactccccgctcgttggcccgggtatcccagcgcggacccacgcgatacgctgacgccccgacgccgatccggccgagccaagtaagggggacggcccgagacggagaagggagagagtgggagtttcccagcccgcagaactttcgaagttgagaaaagaacccctggaacgtgcgctcagcactgggattttctggactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggaggtaggtgtcccagccccagtgggcttctttccaccaggggtggcccaggaagaaagagtgagggtgggtgacttatttacccacagagttgggagctgaagttaggcattttggacaattgatgggggagctgagtctctagaaaagcccaagcacaggctttcgggcaa

SEQ ID NO: 8341 - DNA, 363 bp, Homo sapiens
  ENST00000523433
gttaaccgtatttgttttcccatgcaaatgatagtctgcctgaggagctggttactgacagtgtgggcagcatgactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacat

SEQ ID NO: 8342 - DNA, 1783 bp, Homo sapiens
  ENST00000639277
agagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagagggtactaagcagctccgaaccagcacctcaggcgtgtggtccctggccttggtccgcagcttccttggcacagcccttgagccacaagacaccacatcgggcacggccttgagaacactggcgctcacccaagaatgggtcaaaggaaaccggaatgagaagggcgggccgaggtgctcgggcagggagatctctgcctcagtgctccaggccctgccctgccagcctggtggaaaagtctttcatcaacctgggggatgaaggaaacccaccctcctgcatatctggccatccgggaggctggctggacctgagctgatggcttgggactttcccaggcccaacctgcacaagaactgagtctctaggggaaaattcaacacctcaaatgatgtagtatttgatcatttgttgattacatgtccattcattggtttggggctataaacattcttgttaagagctgtggagatcagtgtttgtttaccataaagattttgctttttcccttt

SEQ ID NO: 8343 - DNA, 6538 bp, Homo sapiens
  ENST00000588735
agggaaacggggcgctgcaggaataaagacgagccagcacagccagctcatgtgtaacggctttgtggagctgtcaaggcctggtctctgggagagaggcacagggaggccagacaaggaaggggtgacctggagggacagatccaggggctaaagtcctgataaggcaagagagtgccggccccctcttgccctatcaggacctccactgccacatagaggccatgattgacccttagacaaagggctggtgtccaatcccagcccccagccccagaactccagggaatgaatgggcagagagcaggaatgtgggacatctgtgttcaagggaaggactccaggagtctgctgggaatgaggcctagtaggaaatgaggtggcccttgagggtacagaacaggttcattcttcgccaaattcccagcaccttgcaggcacttacagctgagtgagataatgcctgggttatgaaatcaaaaagttggaaagcaggtcagaggtcatctggtacagcccttccttcccttttttttttttttttttgtgagacaaggtctctctctgttgcccaggctggagtggcgcaaacacagctcactgcagcctcaacctactgggctcaagcaatcctccagcctcagcctcccaaagtgctgggattacaagcatgagccaccccactcagccctttccttcctttttaattgatgcataataattgtaagtattcatcatggtccaaccaaccctttcttgacccaccttcctagagagagggtcctcttgcttcagcggtcagggccccagacccatggtctggctccaggtaccacctgcctcatgcaggagttggcgtgcccaggaagctctgcctctgggcacagtgacctcagtggggtgaggggagctctccccatagctgggctgcggcccaaccccaccccctcaggctatgccagggggtgttgccaggggcacccgggcatcgccagtctagcccactccttcataaagccctcgcatcccaggagcgagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgtgcctttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggtgggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccaggccgccccagcctctgagcccctgggactgctgcttcttaaccccagtaagccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagatgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagacaaatgctgcgcccttccccagagtggactctgatctgttcatgagagggcgggactggggccaagatgtagcctttgacaagaccaactcatttcttattactgatcatctctggggcccatgccctcaccaaattccacccgcagccaaagaggacatacaccagctccctccactcttttcttccttcctctccctgctacctgcaactcaaccagcacaatcttcataggcaagaaagcaaagcagctcaaacatgattcaacactgatcagtgtttaccactggataaatctgagttcacactttccttctctgacctaaatgtgaagtcaggaaacacatgtgccctacttccatcctgagctcagtccccaatctcccaccagcctcaggcccctccacttctcagatcaggtcccagacctgcccatgaaaatggggagcaggctgtaacagatttgtccacatgttcctaccacctgtcccaacccagggtacccacccagagacatctggtatcatttaacaaacacattgaaggacaactggtcttcagagctgaagagagctcctagggggagaagctgggacaacagtgaaataagtagcagcagcaacgacagaagtgaatggtgacaaagactgctgtgatgagcaggtagcctatcagggtgagctccacagccgagcgagtctcaggatctgagaacgaggctgggtagtgcccatgagatgtcacacccagccggaagccagcaactagcacaccctgcctccagcaatagtagatgccccggtcatccagctgggtgaagcggatgtggagctggttgccgtggtcaatgaacaccctcatggacctgttgacacccttcaggtactgtgtgcggtagaggtgctggcggtctttgtcccaggccactgcatgctctggccgggccccaggacaggagatgatgagtccatggcccagtctctgctggtggaactgaatgggcacctggggcacccagggccggctgcccactttggacacatagttaatgatggccagcacgccctcccggatggtctttgtcttctcacagggtactaagcagctccgaaccagcacctcaggcgtgtggtccctggccttggtccgcagcttccttggcacagcccttgagccacaagacaccacatcgggcacggccttgaggtagcgtggggagaggtctgggctctgcaggtagcagaggccgatgcgccactgctccccacgcactccgcagcggtcacagggggtccattcccagaaggtggtgaagacatggaggtgcccatagtattcatctgcaaagggctcctggcccttgtcctggaaagtggccaccattccctcactgttctggatgtccacatcgtaggcgtaaaagtagtcccccttgcgggtgccgcagaagtacaggcctgagtcctcagactgagccctgaaaaccaacaagctgaacatgcggatgctgaagcgggtcagcatgtcgctgcccacacgtacctgggctgcctccgtcagcacccgcccatcaaagtccgtcagcactttggtgtggctgctacctaggtgcttttggtagaaccagactacagctggcacctcttcgggtttgcagtgacagggaagctcaaagctcatgtcggccaggtaggctgcattttcaaacatcaggaaagcagggcagggggtcctctgaaaaatgttttccttctccacaatttcaaaggcctggagcccccatgcccacaggagcacagtggtgagggccaggtgcatacctgaaggaggcaggggtcagaggggcagggcaaaaccagggcattaaaggctcatagggctcctagaaagctctgctaagcggaagcctctagatgaggaaaggattatgcagccaggaaaagcagcaacaatctgcagaggaagccgccaagtgcaaggcaatttattcccagtggatgtacaagatgcccttctaacattccagacctgatctcagggtggggggggaaagccattctagaacctggcctttactcccctttctagaacactggcgctcacccaagaatgggtcaaaggaaaccggaatgagaagggcgggccgaggtgctcgggcagggagatctctgcctcagtgctccaggccctgccctgccagcctggtggaaaagtctttcatcaacctgggggatgaaggaaacccaccctcctgcatatctggccatccgggaggctggctggacctgagctgatggcttgggactttcccaggcccaacctgcacaagaactgagtctctaggggaaaattcaacacctcaaatgatgtagtatttgatcatttgttgattacatgtccattcattggtttggggctataaacattcttgttaagagctgtggagatcagtgtttgtttaccataaagattttgctttttcccttt

SEQ ID NO: 8344 - DNA, 2139 bp, Homo sapiens
  ENST00000638304
tcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagagggtacccacccagagacatctggtatcatttaacaaacacattgaaggacaactggtcttcagagctgaagagagctcctagggggagaagctgggacaacagtgaaataagtagcagcagcaacgacagaagtgaatggtgacaaagactgctgtgatgagcaggtagcctatcagggtgagctccacagccgagcgagtctcaggatctgagaacgaggctgggtagtgcccatgagatgtcacacccagccggaagccagcaactagcacaccctgcctccagcaatagtagatgccccggtcatccagctgggtgaagcggatgtggagctggttgccgtggtcaatgaacaccctcatggacctgttgacacccttcaggtactgtgtgcggtagaggtgctggcggtctttgtcccaggccactgcatgctctggccgggccccaggacaggagatgatgagtccatggcccagtctctgctggtggaactgaatgggcacctggggcacccagggccggctgcccactttggacacatagttaatgatggccagcacgccctcccggatggtctttgtcttctcacagggtactaagcagctccgaaccagcacctcaggcgtgtggtccctggccttggtccgcagcttccttggcacagcccttgagccacaagacaccacatcgggcacggccttgaggtagcgtggggagaggtctgggctctgcaggtagcagaggccgatgcgccactgctccccacgcactccgcagcggtcacagggggtccattcccagaaggtggtgaagacatggaggtgcccatagtattcatctgcaaagggctcctggcccttgtcctggaaagtggccaccattccctcactgttctggatgtccacatcgtaggcgtaaaagtagtcccccttgcgggtgccgcagaagtacaggcctgagtcctcagactgagccctgaaaaccaacaagctgaacatgcggatgctgaagcgggtcagcatgtcgctgcccacacgtacctgggctgcctccgtcagcacccgcccatcaaagtccgtcagcactttggtgtggctgctacctaggtgcttttggtagaaccagactacagctggcacctcttcgggtttgcagtgacagggaagctcaaagctcatgtcggccaggtaggctgcattttcaaacatcaggaaagcagggcagggggtcctctgaaaaatgttttccttctccacaatttcaaaggcctggagcccccatgcccacaggagcacagtggtgagggccaggtgcatacctgaaggaggcaggggtcagaggggcagggcaaaaccagggcattaaaggctcatagggctcctagaaagctctgctaagcggaagcctctagatgaggaaaggattatgcagccaggaaaagcagcaacaatctgcagaggaagccgccaagtgcaaggcaatttattcccagtggatgtacaagatgcccttctaacattccagacctgatctcagggtggggggggaaagccattctagaacctggcctttactcccctttctagaacactggcgctcacccaagaatgggtcaaaggaaaccggaatgagaagggcgggccgaggtgctcgggcagggagatctctgcctcagtgctccaggccctgccctgccagcctggtggaaaagtctttcatcaacctgggggatgaaggaaacccaccctcctgcatatctggccatccgggaggctggctggacctgagctgatggcttgggactttcccaggcccaacctgcacaagaactgagtctctaggggaaaattcaacacctcaaatgatgtagtatttgatcatttgttgattacatgtccattcattggtttggggctataaacattcttgttaagagctgtggagatcagtgtttgttta

SEQ ID NO: 8345 - DNA, 979 bp, Homo sapiens
  ENST00000441312
gcgctttgcccagcttgacagggaaaaccagcctggacaccaagtctgtgtcagaaggccacctcaagaggaacatcgtggtgaagaccgtggagatgcgggatggagagggtacccacccagagacatctggtatcatttaacaaacacattgaaggacaactggtcttcagagctgaagagagctcctagggggagaagctgggacaacagtgaaataagtagcagcagcaacgacagaagtgaatggtgacaaagactgctgtgatgagcaggtagcctatcagggtgagctccacagccgagcgagtctcaggatctgagaacgaggctgggtagtgcccatgagatgtcacacccagccggaagccagcaactagcacaccctgcctccagcaatagtagatgccccggtcatccagctgggtgaagcggatgtggagctggttgccgtggtcaatgaacaccctcatggacctgttgacacccttcagggtactaagcagctccgaaccagcacctcaggcgtgtggtccctggccttggtccgcagcttccttggcacagcccttgagccacaagacaccacatcgggcacggccttgagaacactggcgctcacccaagaatgggtcaaaggaaaccggaatgagaagggcgggccgaggtgctcgggcagggagatctctgcctcagtgctccaggccctgccctgccagcctggtggaaaagtctttcatcaacctgggggatgaaggaaacccaccctcctgcatatctggccatccgggaggctggctggacctgagctgatggcttgggactttcccaggcccaacctgcacaagaactgagtctctaggggaaaattcaacacctcaaatgatgtagtatttgatcatttgttgattacatgtccattcattggtttggggctataaacattcttgttaagagctgtggagatcagtgtttgttt

SEQ ID NO: 8346 - DNA, 1566 bp, Homo sapiens
  ENST00000639243
gcgggatggagagggtacccacccagagacatctggtatcatttaacaaacacattgaaggacaactggtcttcagagctgaagagagctcctagggggagaagctgggacaacagtgaaataagtagcagcagcaacgacagaagtgaatggtgacaaagactgctgtgatgagcaggtagcctatcagggtgagctccacagccgagcgagtctcaggatctgagaacgaggctgggtagtgcccatgagatgtcacacccagccggaagccagcaactagcacaccctgcctccagcaatagtagatgccccggtcatccagctgggtgaagcggatgtggagctggttgccgtggtcaatgaacaccctcatggacctgttgacacccttcaggtactgtgtgcggtagaggtgctggcggtctttgtcccaggccactgcatgctctggccgggccccaggacaggagatgatgagtccatggcccagtctctgctggtggaactgaatgggcacctggggcacccagggccggctgcccactttggacacatagttaatgatggccagcacgccctcccggatggtctttgtcttctcacagggtactaagcagctccgaaccagcacctcaggcgtgtggtccctggccttggtccgcagcttccttggcacagcccttgagccacaagacaccacatcgggcacggccttgaggtagcgtggggagaggtctgggctctgcaggtagcagaggccgatgcgccactgctccccacgcactccgcagcggtcacagggggtccattcccagaaggtggtgaagacatggaggtgcccatagtattcatctgcaaagggctcctggcccttgtcctggaaagtggccaccattccctcactgttctggatgtccacatcgtaggcgtaaaagtagtcccccttgcgggtgccgcagaagtacaggcctgagtcctcagactgagccctgaaaaccaacaagctgaacatgcggatgctgaagcgggtcagcatgtcgctgcccacacgtacctgggctgcctccgtcagcacccgcccatcaaagtccgtcagcactttggtgtggctgctacctaggtgcttttggtagaaccagactacagctggcacctcttcgggtttgcagtgacagggaagctcaaagctcatgtcggccagaacactggcgctcacccaagaatgggtcaaaggaaaccggaatgagaagggcgggccgaggtgctcgggcagggagatctctgcctcagtgctccaggccctgccctgccagcctggtggaaaagtctttcatcaacctgggggatgaaggaaacccaccctcctgcatatctggccatccgggaggctggctggacctgagctgatggcttgggactttcccaggcccaacctgcacaagaactgagtctctaggggaaaattcaacacctcaaatgatgtagtatttgatcatttgttgattacatgtccattcattggtttggggctataaacattcttgttaagagctgtggagatca

SEQ ID NO: 8347 - DNA, 2641 bp, Homo sapiens
  ENST00000638488
aatgtcaagctggccctggacatcgagatcgccacctacaggaagctgctagagggcgaggagaaccggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctagccagagcctatcataccagggtacttctaggtggggcttgcagctgcccctgtcctgctaggccctggtccctcttcccctccctgcaccccattcgacagcagaactgggtgagagcttgacatctgccctgtctgcagatccctgagcaagcactgcccttctgagtgttttctgtttttgtttttttaactgcttgtcactacagggggcaaaagcaccaaagacggggaaaatcacaaggtcacaagatatctcaaaagcctcacaatacgagttataccaatacaggctcaccagattgtaaatggaacgccgccggctcgcggttagctgcctgcctctcagacacggcgctttgcccagcttgacagggaaaaccagcctggacaccaagtctgtgtcagaaggccacctcaagaggaacatcgtggtgaagaccgtggagatgcgggatggagagggtacccacccagagacatctggtatcatttaacaaacacattgaaggacaactggtcttcagagctgaagagagctcctagggggagaagctgggacaacagtgaaataagtagcagcagcaacgacagaagtgaatggtgacaaagactgctgtgatgagcaggtagcctatcagggtgagctccacagccgagcgagtctcaggatctgagaacgaggctgggtagtgcccatgagatgtcacacccagccggaagccagcaactagcacaccctgcctccagcaatagtagatgccccggtcatccagctgggtgaagcggatgtggagctggttgccgtggtcaatgaacaccctcatggacctgttgacacccttcaggtactgtgtgcggtagaggtgctggcggtctttgtcccaggccactgcatgctctggccgggccccaggacaggagatgatgagtccatggcccagtctctgctggtggaactgaatgggcacctggggcacccagggccggctgcccactttggacacatagttaatgatggccagcacgccctcccggatggtctttgtcttctcacagggtactaagcagctccgaaccagcacctcaggcgtgtggtccctggccttggtccgcagcttccttggcacagcccttgagccacaagacaccacatcgggcacggccttgaggtagcgtggggagaggtctgggctctgcaggtagcagaggccgatgcgccactgctccccacgcactccgcagcggtcacagggggtccattcccagaaggtggtgaagacatggaggtgcccatagtattcatctgcaaagggctcctggcccttgtcctggaaagtggccaccattccctcactgttctggatgtccacatcgtaggcgtaaaagtagtcccccttgcgggtgccgcagaagtacaggcctgagtcctcagactgagccctgaaaaccaacaagctgaacatgcggatgctgaagcgggtcagcatgtcgctgcccacacgtacctgggctgcctccgtcagcacccgcccatcaaagtccgtcagcactttggtgtggctgctacctaggtgcttttggtagaaccagactacagctggcacctcttcgggtttgcagtgacagggaagctcaaagctcatgtcggccaggtaggctgcattttcaaacatcaggaaagcagggcagggggtcctctgaaaaatgttttccttctccacaatttcaaaggcctggagcccccatgcccacaggagcacagtggtgagggccaggtgcatacctgaaggaggcaggggtcagaggggcagggcaaaaccagggcattaaaggctcatagggctcctagaaagctctgctaagcggaagcctctagatgaggaaaggattatgcagccaggaaaagcagcaacaatctgcagaggaagccgccaagtgcaaggcaatttattcccagtggatgtacaagatgcccttctaacattccagacctgatctcagggtggggggggaaagccattctagaacctggcctttactcccctttctagaacactggcgctcacccaagaatgggtcaaaggaaaccggaatgagaagggcgggccgaggtgctcgggcagggagatctctgcctcagtgctccaggccctgccctgccagcctggtggaaaagtctttcatcaacctgggggatgaaggaaacccaccctcctgcatatctggccatccgggaggctggctggacctgagctgatggcttgggactttcccaggcccaacctgcacaagaactgagtctctaggggaaaattcaacacctcaaatgatgtagtatttgatcatttgttgattacatgtccattcattggtttggggct

SEQ ID NO: 8348 - DNA, 930 bp, Homo sapiens
  ENST00000639369
tctccaacctgcagattcgagaaaccagcctggacaccaagtctgtgtcagaaggccacctcaagaggaacatcgtggtgaagaccgtggagatgcgggatggagagggtacccacccagagacatctggtatcatttaacaaacacattgaaggacaactggtcttcagagctgaagagagctcctagggggagaagctgggacaacagtgaaataagtagcagcagcaacgacagaagtgaatggtgacaaagactgctgtgatgagcaggtagcctatcagggtgagctccacagccgagcgagtctcaggatctgagaacgaggctgggtagtgcccatgagatgtcacacccagccggaagccagcaactagcacaccctgcctccagcaatagtagatgccccggtcatccagctgggtgaagcggatgtggagctggttgccgtggtcaatgaacaccctcatggacctgttgacacccttcagggtactaagcagctccgaaccagcacctcaggcgtgtggtccctggccttggtccgcagcttccttggcacagcccttgagccacaagacaccacatcgggcacggccttgagaacactggcgctcacccaagaatgggtcaaaggaaaccggaatgagaagggcgggccgaggtgctcgggcagggagatctctgcctcagtgctccaggccctgccctgccagcctggtggaaaagtctttcatcaacctgggggatgaaggaaacccaccctcctgcatatctggccatccgggaggctggctggacctgagctgatggcttgggactttcccaggcccaacctgcacaagaactgagtctctaggggaaaattcaacacctcaaatgatgtagtatttgatcatttgttgattacatgtccattcattggtttgg

SEQ ID NO: 8349 - DNA, 2539 bp, Homo sapiens
  ENST00000592065
gggtttcaccatattagtcaggctggtctcaaactcctgacctcaggcgatccacctgcctcggcctcccaaagtgctgggattacaggtgtgagccaccatgcctggcctattttttgtatttttagtagaggtttcactatgttggccaggctggtctcgaactcctggcgtcaggtgatccacctgcctcagcctcccaaaatgatggcattataggtgtgagccaccgcacccctcctggtctcctgatttcaataccgtgctgggttttcagaaagccaggtgccaggccagggcttgcagaggggctgaaatgaagccaggccagaagacagagcagccaggactctggcagcagcactattgggatttgggggctctccagcccgtttggaagagcctaggctctctctgctcggttgcataggttctcatactcatgatggggaggggggtgcgatggggaagccgggcatgggagaggatggctcatgccctgaaagtccatgagaggcctcctctccccacatctgcagaaaccagcctggacaccaagtctgtgtcagaaggccacctcaagaggaacatcgtggtgaagaccgtggagatgcgggatggagagggtacccacccagagacatctggtatcatttaacaaacacattgaaggacaactggtcttcagagctgaagagagctcctagggggagaagctgggacaacagtgaaataagtagcagcagcaacgacagaagtgaatggtgacaaagactgctgtgatgagcaggtagcctatcagggtgagctccacagccgagcgagtctcaggatctgagaacgaggctgggtagtgcccatgagatgtcacacccagccggaagccagcaactagcacaccctgcctccagcaatagtagatgccccggtcatccagctgggtgaagcggatgtggagctggttgccgtggtcaatgaacaccctcatggacctgttgacacccttcaggtactgtgtgcggtagaggtgctggcggtctttgtcccaggccactgcatgctctggccgggccccaggacaggagatgatgagtccatggcccagtctctgctggtggaactgaatgggcacctggggcacccagggccggctgcccactttggacacatagttaatgatggccagcacgccctcccggatggtctttgtcttctcacagggtactaagcagctccgaaccagcacctcaggcgtgtggtccctggccttggtccgcagcttccttggcacagcccttgagccacaagacaccacatcgggcacggccttgaggtagcgtggggagaggtctgggctctgcaggtagcagaggccgatgcgccactgctccccacgcactccgcagcggtcacagggggtccattcccagaaggtggtgaagacatggaggtgcccatagtattcatctgcaaagggctcctggcccttgtcctggaaagtggccaccattccctcactgttctggatgtccacatcgtaggcgtaaaagtagtcccccttgcgggtgccgcagaagtacaggcctgagtcctcagactgagccctgaaaaccaacaagctgaacatgcggatgctgaagcgggtcagcatgtcgctgcccacacgtacctgggctgcctccgtcagcacccgcccatcaaagtccgtcagcactttggtgtggctgctacctaggtgcttttggtagaaccagactacagctggcacctcttcgggtttgcagtgacagggaagctcaaagctcatgtcggccaggtaggctgcattttcaaacatcaggaaagcagggcagggggtcctctgaaaaatgttttccttctccacaatttcaaaggcctggagcccccatgcccacaggagcacagtggtgagggccaggtgcatacctgaaggaggcaggggtcagaggggcagggcaaaaccagggcattaaaggctcatagggctcctagaaagctctgctaagcggaagcctctagatgaggaaaggattatgcagccaggaaaagcagcaacaatctgcagaggaagccgccaagtgcaaggcaatttattcccagtggatgtacaagatgcccttctaacattccagacctgatctcagggtggggggggaaagccattctagaacctggcctttactcccctttctagaacactggcgctcacccaagaatgggtcaaaggaaaccggaatgagaagggcgggccgaggtgctcgggcagggagatctctgcctcagtgctccaggccctgccctgccagcctggtggaaaagtctttcatcaacctgggggatgaaggaaacccaccctcctgcatatctggccatccgggaggctggctggacctgagctgatggcttgggactttcccaggcccaacctgcacaagaactgagtctctaggggaaaattcaacacctcaaatgatgtagtatttgatcatttgttgattacatgtccattcattggttt

SEQ ID NO: 8350 - DNA, 1162 bp, Homo sapiens
  ENST00000640859
ccaagtctgtgtcagaaggccacctcaagaggaacatcgtggtgaagaccgtggagatgcgggatggagagggtacccacccagagacatctggtatcatttaacaaacacattgaaggacaactggtcttcagagctgaagagagctcctagggggagaagctgggacaacagtgaaataagtagcagcagcaacgacagaagtgaatggtgacaaagactgctgtgatgagcaggtagcctatcagggtgagctccacagccgagcgagtctcaggatctgagaacgaggctgggtagtgcccatgagatgtcacacccagccggaagccagcaactagcacaccctgcctccagcaatagtagatgccccggtcatccagctgggtgaagcggatgtggagctggttgccgtggtcaatgaacaccctcatggacctgttgacacccttcagggtactaagcagctccgaaccagcacctcaggcgtgtggtccctggccttggtccgcagcttccttggcacagcccttgagccacaagacaccacatcgggcacggccttgaggcgtaaaagtagtcccccttgcgggtgccgcagaagtacaggcctgagtcctcagactgagccctgaaaaccaacaagctgaacatgcggatgctgaagcgggtcagcatgtcgctgcccacacgtacctgggctgcctccgtcagcacccgcccatcaaagtccgtcagcactttggtgtggctgctacctaggtgcttttggtagaaccagactacagctggcacctcttcgggtttgcagtgacagggaagctcaaagctcatgtcggccagaacactggcgctcacccaagaatgggtcaaaggaaaccggaatgagaagggcgggccgaggtgctcgggcagggagatctctgcctcagtgctccaggccctgccctgccagcctggtggaaaagtctttcatcaacctgggggatgaaggaaacccaccctcctgcatatctggccatccgggaggctggctggacctgagctgatggcttgggactttcccaggcccaacctgcacaagaactgagtctctaggggaaaattcaacacctcaaatgatgtagtatttgatcatttgttgattacatgtccattcatt

SEQ ID NO: 8351 - DNA, 1106 bp, Homo sapiens
  ENST00000638400
ttcgagaaaccagcctggacaccaagtctgtgtcagaaggccacctcaagaggaacatcgtggtgaagaccgtggagatgcgggatggagagggtacccacccagagacatctggtatcatttaacaaacacattgaaggacaactggtcttcagagctgaagagagctcctagggggagaagctgggacaacagtgaaataagtagcagcagcaacgacagaagtgaatggtgacaaagactgctgtgatgagcaggtagcctatcagggtgagctccacagccgagcgagtctcaggatctgagaacgaggctgggtagtgcccatgagatgtcacacccagccggaagccagcaactagcacaccctgcctccagcaatagtagatgccccggtcatccagctgggtgaagcggatgtggagctggttgccgtggtcaatgaacaccctcatggacctgttgacacccttcaggtactgtgtgcggtagaggtgctggcggtctttgtcccaggccactgcatgctctggccgggccccaggacaggagatgatgagtccatggcccagtctctgctggtggaactgaatgggcacctggggcacccagggccggctgcccactttggacacatagttaatgatggccagcacgccctcccggatggtctttgtcttctcacagggtactaagcagctccgaaccagcacctcaggcgtgtggtccctggccttggtccgcagcttccttggcacagcccttgagccacaagacaccacatcgggcacggccttgagaacactggcgctcacccaagaatgggtcaaaggaaaccggaatgagaagggcgggccgaggtgctcgggcagggagatctctgcctcagtgctccaggccctgccctgccagcctggtggaaaagtctttcatcaacctgggggatgaaggaaacccaccctcctgcatatctggccatccgggaggctggctggacctgagctgatggcttgggactttcccaggcccaacctgcacaagaactgagtctctaggggaaaattcaacacctcaaatgatgtagtatttgatcatttgttgattac

SEQ ID NO: 8352 - DNA, 1533 bp, Homo sapiens
  ENST00000639042
tcaagctggccctggacatcgagatcgccacctacaggaagctgctagagggcgaggagaaccggatcaccattcccgtgcagaccttctccaacctgcagattcgagggggcaaaagcaccaaagacggggaaaatcacaagaaaccagcctggacaccaagtctgtgtcagaaggccacctcaagaggaacatcgtggtgaagaccgtggagatgcgggatggagagccaaagaggacatacaccagctccctccactcttttcttccttcctctccctgctacctgcaactcaaccagcacaatcttcataggcaagaaagcaaagcagctcaaacatgattcaacactgatcagtgtttaccactggataaatctgagttcacactttccttctctgacctaaatgtgaagtcaggaaacacatgtgccctacttccatcctgagctcagtccccaatctcccaccagcctcaggcccctccacttctcagatcaggtcccagacctgcccatgaaaatggggagcaggctgtaacagatttgtccacatgttcctaccacctgtcccaacccagggtacccacccagagacatctggtatcatttaacaaacacattgaaggacaactggtcttcagagctgaagagagctcctagggggagaagctgggacaacagtgaaataagtagcagcagcaacgacagaagtgaatggtgacaaagactgctgtgatgagcaggtagcctatcagggtgagctccacagccgagcgagtctcaggatctgagaacgaggctgggtagtgcccatgagatgtcacacccagccggaagccagcaactagcacaccctgcctccagcaatagtagatgccccggtcatccagctgggtgaagcggatgtggagctggttgccgtggtcaatgaacaccctcatggacctgttgacacccttcaggtactgtgtgcggtagaggtgctggcggtctttgtcccaggccactgcatgctctggccgggccccaggacaggagatgatgagtccatggcccagtctctgctggtggaactgaatgggcacctggggcacccagggccggctgcccactttggacacatagttaatgatggccagcacgccctcccggatggtctttgtcttctcacagggtactaagcagctccgaaccagcacctcaggcgtgtggtccctggccttggtccgcagcttccttggcacagcccttgagccacaagacaccacatcgggcacggccttgagaacactggcgctcacccaagaatgggtcaaaggaaaccggaatgagaagggcgggccgaggtgctcgggcagggagatctctgcctcagtgctccaggccctgccctgccagcctggtggaaaagtctttcatcaacctgggggatgaaggaaacccaccctcctgcatatctggccatccgggaggctggctggacctgagctgatggcttgggactttcccaggcccaacctgcacaagaactg

SEQ ID NO: 8353 - DNA, 538 bp, Homo sapiens
  ENST00000640545
gtgtcagaaggccacctcaagaggaacatcgtggtgaagaccgtggagatgcgggatggagagggtactaagcagctccgaaccagcacctcaggcgtgtggtccctggccttggtccgcagcttccttggcacagcccttgagccacaagacaccacatcgggcacggccttgaggtagcgtggggagaggtctgggctctgcaggtagcagaggccgatgcgccactgctccccacgcactccgcagcggtcacagggggtccattcccagaaggtggtgaagacatggaggtgcccatagtattcatctgcaaagggctcctggcccttgtcctggaaagtggccaccattccctcactgttctggatgtccacatcgtaggcgtaaaagtagtcccccttgcgggtgccgcagaagtacaggcctgagtcctcagactgagccctgaaaaccaacaagctgaacatgcggatgctgaagcgggtcagcatgtcgctgcccacacgtacctgggctgcctccgtcagcacccgcc

SEQ ID NO: 8354 - DNA, 2617 bp, Homo sapiens
  ENST00000638921
catgatggggaggggggtgcgatggggaagccgggcatgggagaggatggctcatgccctgaaagtccatgagaggcctcctctccccacatctgcagaaaccagcctggacaccaagtctgtgtcagaaggccacctcaagaggaacatcgtggtgaagaccgtggagatgcgggatggagaggtaaggagggatttgggcccagtcaggctctggctggccccagggattctcaaggccaggccatggaggaaagcctggggctggcacatagaaggttcccagcaactcccagtagctccccagggaattctggaggagagcaaggaaactgaatgtaattccgtttcctcagtccctccataggctgttctaaggggagccttggtaccaaagccactagatgggatcctaatacacactctctctttctcaccctcaaactcgggggccttgcttgccagggagagaaagagaattaaagttagtagctttcacttccaactctagcagacacagttggggatggggagggctttccatttccagcttggtaaaaggaaactaccaggggaatgggaagaggggatttggcgtatccgccacgccactccaaccacagtgggagctcatcttactccagcagcttaccactcgccaggcatgacgctaaatgctttcccagtgttatctcaccaccccctctgtccaccacgcaaggcagctgtggttactatcaagaaaagtaagacctgggaagtcggggacttcccaaggttacacagcctcgtggtggtggacctggggtctgtgtgaactcctaactgttgcactgtgcacgttccctgtcccctgcaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgtgcctttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggtgggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccaggccgccccagcctctgagcccctgggactgctgcttcttaaccccagtaagccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagatgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagacaaatgctgcgccctt

SEQ ID NO: 8355 - DNA, 3135 bp, Homo sapiens
  ENST00000253408
agagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcgaaaccagcctggacaccaagtctgtgtcagaaggccacctcaagaggaacatcgtggtgaagaccgtggagatgcgggatggagaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgtgcctttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggtgggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccaggccgccccagcctctgagcccctgggactgctgcttcttaaccccagtaagccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagatgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagaca

SEQ ID NO: 8356 - DNA, 2542 bp, Homo sapiens
  ENST00000586125
aagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtaaggagggatttgggcccagtcaggctctggctggccccagggattctcaaggccaggccatggaggaaagcctggggctggcacatagaaggttcccagcaactcccagtagctccccagggaattctggaggagagcaaggaaactgaatgtaattccgtttcctcagtccctccataggctgttctaaggggagccttggtaccaaagccactagatgggatcctaatacacactctctctttctcaccctcaaactcgggggccttgcttgccagggagagaaagagaattaaagttagtagctttcacttccaactctagcagacacagttggggatggggagggctttccatttccagcttggtaaaaggaaactaccaggggaatgggaagaggggatttggcgtatccgccacgccactccaaccacagtgggagctcatcttactccagcagcttaccactcgccaggcatgacgctaaatgctttcccagtgttatctcaccaccccctctgtccaccacgcaaggcagctgtggttactatcaagaaaagtaagacctgggaagtcggggacttcccaaggttacacagcctcgtggtggtggacctggggtctgtgtgaactcctaactgttgcactgtgcacgttccctgtcccctgcaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgtgcctttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggtgggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccaggccgccccagcctctgagcccctgggactgctgcttcttaaccccagtaagccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagatgggactgggagggcccacttcagggttctcctctcccctctaaggccgaagaagggtccttccctctccccaagacttggtgtcctttccctccactccttcctgccacct

SEQ ID NO: 8357 - DNA, 989 bp, Homo sapiens
  ENST00000638618
taccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggccgccccagcctctgagcccctgggactgctgcttcttaaccccagtaagccactgccacacgtctgaccctctcc

SEQ ID NO: 8358 - DNA, 2668 bp, Homo sapiens
  ENST00000589701
aggtcacaagatatctcaaaagcctcacaatacgagttataccaatacaggctcaccagattgtaaatggaacgccgccggctcgcggttagctgcctgcctctcagacacggcgctttgcccagcttgacagggagtgagcctcacccaccccatcctcccaatccccctgagttccctcttcccaggcttcccctaaagggcctggactgcgtcattttcccaggaactgcagtgcccagcccaggacgtggtacagagtaactgtacattaaactggcagagcttgttagtggtaaaggtggtgagtccttgggtgcgcagtggagctgctctggggcctctgagcaagcagcagcctctgtctcacctcttcctgtcactgggagggccccttgggtctcgctgtgcctggacgccaggctctctgctttattctttcatccctgaggctccatcgctcagctcagtgctgactcagttcagaggattcttccctcaggaccgcagctcttgcagtgaataaagttttatgttccctgctcttaatgttaaatattagtgaatgtgacgtgttatatttttctctctcgggcggggcggggggaggggggagctaaattactttttacttgcattggccctgaaatgattcttagctaaggaacaaaattcctcttcttctggactagaatatttaggaccactagatatgcatgtctcaggacttaattcagcatcagaaaggctaaccaggctgactagtagaggtaatactgccaaatcctagatagtcacaggtcactaaagcacagataaatggcagagagaagtaggaaagaggaaaggggacaggaaagggacctatgtgtattgagcactaatatgtgccacatgtttaacagcctttattttagttaattgtctcctctctcccacctagagaagtaggccccatcatccttattttacagatgaggaaactgaggctgggagaggtcaattaacttgcccagagtcatgtggctggttggtggctaagttgggacttcttgagctctggtctcctgatccttccttccttccttccttcttttcttccttccttccttctttccttccttccttcggcagagcgtccctctgtcactcaggctggaatgcagtagtgcaatcttggctcactgcaacctccacctcccaggttcaagcaattctcgtgcctcagactcccgagtaaggggattacaggtgcgagccaccacacctggctaatctttctttttctttctttctttctttcttccttccttccttccttccttcctttctctttcctgcttgcttgcttgcttgcttgcctgctttcgacggagtcttactctgttgctcaggctggagtgcagtggcacgatcgcagcttactgcaacctccgcctcccaggttcaagtgattctcctctctcagcctcctgagtagctgggactacaggcacctgtcaccatgcctgactaatttttgtatttttagtagagacagggtttcaccatattagtcaggctggtctcaaactcctgacctcaggcgatccacctgcctcggcctcccaaagtgctgggattacaggtgtgagccaccatgcctggcctattttttgtatttttagtagaggtttcactatgttggccaggctggtctcgaactcctggcgtcaggtgatccacctgcctcagcctcccaaaatgatggcattataggtgtgagccaccgcacccctcctggtctcctgatttcaataccgtgctgggttttcagaaagccaggtgccaggccagggcttgcagaggggctgaaatgaagccaggccagaagacagagcagccaggactctggcagcagcactattgggatttgggggctctccagcccgtttggaagagcctaggctctctctgctcggttgcataggttctcatactcatgatggggaggggggtgcgatggggaagccgggcatgggagaggatggctcatgccctgaaagtccatgagaggcctcctctccccacatctgcagaaaccagcctggacaccaagtctgtgtcagaaggccacctcaagaggaacatcgtggtgaagaccgtggagatgcgggatggagaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgtgcctttgagtttcctcaggctgctggaggaaaactgagactcagacaggaaagg

SEQ ID NO: 8359 - DNA, 579 bp, Homo sapiens
  ENST00000592706
actcagttcagaggattcttccctcaggaccgcagctcttgcaaaaccagcctggacaccaagtctgtgtcagaaggccacctcaagaggaacatcgtggtgaagaccgtggagatgcgggatggagaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgt

SEQ ID NO: 8360 - DNA, 594 bp, Homo sapiens
  ENST00000585543
ctcgaaacctccccaagtcgggtcggggctccgcgggaccggccggctccatcccacagaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtcccta

SEQ ID NO: 8361 - DNA, 1103 bp, Homo sapiens
  ENST00000591880
ggccctggacatcgagatcgccacctacaggaagctgctagagggcgaggagaaccggatcaccattcccgtgcagaccttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcggttagctgcctgcctctcagacacggcgctttgcccagcttgacagggaaaaccagcctggacaccaagtctgtgtcagaaggccacctcaagaggaacatcgtggtgaagaccgtggagatgcgggatggagaggtaaggagggatttgggcccagtcaggctctggctggccccagggattctcaaggccaggccatggaggaaagcctggggctggcacatagaaggttcccagcaactcccagtagctccccagggaattctggaggagagcaaggaaactgaatgtaattccgtttcctcagtccctccataggctgttctaaggggagccttggtaccaaagccactagatgggatcctaatacacactctctctttctcaccctcaaactcgggggccttgcttgccagggagagaaagagaattaaagttagtagctttcacttccaactctagcagacacagttggggatggggagggctttccatttccagcttggtaaaaggaaactaccaggggaatgggaagaggggatttggcgtatccgccacgccactccaaccacagtgggagctcatcttactccagcagcttaccactcgccaggcatgacgctaaatgctttcccagtgttatctcaccaccccctctgtccaccacgcaaggcagctgtggttactatcaagaaaagtaagacctgggaagtcggggacttcccaaggttacacagcctcgtggtggtggacctggggtctgtgtgaactcctaactgttgcactgtgcacgttccctgtcccctgcaggtcattaaggagtccaagcaggagcacaaggatgtgatgtgaggcaggacccacctggtggcctctgccccg

SEQ ID NO: 8362 - DNA, 566 bp, Homo sapiens
  ENST00000588640
aaagtcacacagctcctaagtggtagagttggatttccaactctagcacatctcacttgggagcctgcattccatgcctctgccagtctgttttgggttactgagcctctaccatatgccaggcaccccccaggacacagagaggtgtctgacctggaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggaca

SEQ ID NO: 8363 - DNA, 3573 bp, Homo sapiens
  ENST00000640552
agagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctagccagagcctatcataccagggtacttctaggtggggcttgcagctgcccctgtcctgctaggccctggtccctcttcccctccctgcaccccattcgacagcagaactgggtgagagcttgacatctgccctgtctgcagatccctgagcaagcactgcccttctgagtgttttctgtttttgtttttttaactgcttgtcactacagggggcaaaagcaccaaagacggggaaaatcacaaggtcacaagatatctcaaaagcctcacaatacgagttataccaatacaggctcaccagattgtaaatggaacgccgccggctcgcggttagctgcctgcctctcagacacggcgctttgcccagcttgacagggagtgagcctcacccaccccatcctcccaatccccctgagttccctcttcccaggcttcccctaaagggcctggactgcgtcattttcccaggaactgcagtgcccagcccaggacgtggtacagagtaactgtacattaaactggcagagcttgttagtggtaaaggtggtgagtccttgggtgcgcagtggagctgctctggggcctctgagcaagcagcagcctctgtctcacctcttcctgtcactgggagggccccttgggtctcgctgtgcctggacgccaggctctctgctttattctttcatccctgaggctccatcgctcagctcagtgctgactcagttcagaggattcttccctcaggaccgcagctcttgcagtgaataaagttttatgttccctgctcttaatgttaaatattagtgaatgtgacgtgttatatttttctctctcgggcggggcggggggaggggggagctaaattactttttacttgcattggccctgaaatgattcttagctaaggaacaaaattcctcttcttctggactagaatatttaggaccactagatatgcatgtctcaggacttaattcagcatcagaaaggctaaccaggctgactagtagaggtaatactgccaaatcctagatagtcacaggtcactaaagcacagataaatggcagagagaagtaggaaagaggaaaggggacaggaaagggacctatgtgtattgagcactaatatgtgccacatgtttaacagcctttattttagttaattgtctcctctctcccacctagagaagtaggccccatcatccttattttacagatgaggaaactgaggctgggagaggtcaattaacttgcccagagtcatgtggctggttggtggctaagttgggacttcttgagctctggtctcctgatccttccttccttccttccttcttttcttccttccttccttctttccttccttccttcggcagagcgtccctctgtcactcaggctggaatgcagtagtgcaatcttggctcactgcaacctccacctcccaggttcaagcaattctcgtgcctcagactcccgagtaaggggattacaggtgcgagccaccacacctggctaatctttctttttctttctttctttctttcttccttccttccttccttccttcctttctctttcctgcttgcttgcttgcttgcttgcctgctttcgacggagtcttactctgttgctcaggctggagtgcagtggcacgatcgcagcttactgcaacctccgcctcccaggttcaagtgattctcctctctcagcctcctgagtagctgggactacaggcacctgtcaccatgcctgactaatttttgtatttttagtagagacagggtttcaccatattagtcaggctggtctcaaactcctgacctcaggcgatccacctgcctcggcctcccaaagtgctgggattacaggtgtgagccaccatgcctggcctattttttgtatttttagtagaggtttcactatgttggccaggctggtctcgaactcctggcgtcaggtgatccacctgcctcagcctcccaaaatgatggcattataggtgtgagccaccgcacccctcctggtctcctgatttcaataccgtgctgggttttcagaaagccaggtgccaggccagggcttgcagaggggctgaaatgaagccaggccagaagacagagcagccaggactctggcagcagcactattgggatttgggggctctccagcccgtttggaagagcctaggctctctctgctcggttgcataggttctcatactcatgatggggaggggggtgcg

SEQ ID NO: 8364 - DNA, 1779 bp, Homo sapiens
  ENST00000435360
agagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcggttagctgcctgcctctcagacacggcgctttgcccagcttgacagggagtgagcctcacccaccccatcctcccaatccccctgagttccctcttcccaggcttcccctaaagggcctggactgcgtcattttcccaggaactgcagtgcccagcccaggacgtggtacagagtaactgtacattaaactggcagagcttgttagtggtaaaggtggtgagtccttgggtgcgcagtggagctgctctggggcctctgagcaagcagcagcctctgtctcacctcttcctgtcactgggagggccccttgggtctcgctgtgcctggacgccaggctctctgctttattctttcatccctgaggctccatcgctcagctcagtgctgactcagttcagaggattcttccctcaggaccgcagctcttgcagtgaataaagttttatgttccctgctcttaatgttaaatatta

SEQ ID NO: 8365 - DNA, 3255 bp, Homo sapiens
  ENST00000591327
gagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagtgaggaggggatggggaaggggggccttgtgagcagaaggggctgaatccccaagaaggagtgcccgagaagtctcagggaggggccgaacctccctgctccctgggcctccctacctcttgatggggcactatccttgccccccaacatgatgggagggaccagaaacaggcccagggccccggggatctgatgcccgcatgccttctgccaggagtccagggtcccctcagcacctccctactggggaaagcagtgcaggagcagcggggcccctgtgtttcattcatggctgggctttgtgactgtgggcagcgagctcacctattctgagcctgtgtccatataaaggaggagttggaagcggagaaggttgatgtccatgagggagattggattctggggtgaagaaagtgagggaaagagcaggcaggtctgggcgcaaagcacaggtgactgcctgccaccagcttgtgacccccatcaagttactttgacttgcacagctgtgaagcggtggtcataataaaattcatttcaaaaggtggttacctgggatcagaggaatccccaggggcatggcgcttcactgagctgacaggacatgcatgtgtgccttcaagtgcaggaggacatgtgcgtgtgtgtgtgtgtgtgtgcaacagtgagtgtatgcttgtggatgcgcctgtgtgagcagaagcaggtgcaccaaccctgataaggcaccttagtaatgagttaaggcaaaagcccacatctgctcatcctccagacaagtcctctgtctaaggccccccaacccttaatcctcctgctgctctactggtcctgggtgggggtggtctctgtgacagctgcctcaagggagactgaggcaggtattcaagtgtcctcagaagagcctggacccaggaatgtgtccccccactccaggctccaggatgaaaccaacctgaggctggaagccgagaacaacctggctgcctatagacaggtcagggaggtggaggggaggggcaggggagggaggaaaggattgatggccacccacccaaacacagcccccaagctcagcccgccagagcaatgtgctgctccccactgccccagaaggaggggtaaggcaaggctgaggaatggggagaaggagcctggggccccagtggccctctactcctcacccctcctgccactccaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctagccagagcctatcataccagggtacttctaggtggggcttgcagctgcccctgtcctgctaggccctggtccctcttcccctccctgcaccccattcgacagcagaactgggtgagagcttgacatctgccctgtctgcagatccctgagcaagcactgcccttctgagtgttttctgtttttgtttttttaactgcttgtcactacagggggcaaaagcaccaaagacggggaaaatcacaaggtcacaagatatctcaaaagcctcacaatacgagttataccaatacaggctcaccagattgtaaatggaacgccgccggctcgcggttagctgcctgcctctcagacacggcgctttgcccagcttgacagggagtgagcctcacccaccccatcctcccaatccccctgagttccctcttcccaggcttcccctaaagggcctggactgcgtcattttcccaggaactgcagtgcccagcccaggacgtggtacagagtaactgtacattaaactggcagagcttgttagtggtaaaggtggtgagtccttgggtgcgcagtggagctgctctggggcctctgagcaagcagcagcctctgtctcacctcttcctgtcactgggagggccccttgggtctcgctgtgcctggacgccaggctctctgctttattctttcatccctgaggctccatcgctcagctcagtgctgactcagttcagaggattcttccctcaggaccgcagctcttgcagtgaataaagttttatgttccctgc

SEQ ID NO: 8366 - DNA, 2099 bp, Homo sapiens
  ENST00000638281
atggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctagccagagcctatcataccagggtacttctaggtggggcttgcagctgcccctgtcctgctaggccctggtccctcttcccctccctgcaccccattcgacagcagaactgggtgagagcttgacatctgccctgtctgcagatccctgagcaagcactgcccttctgagtgttttctgtttttgtttttttaactgcttgtcactacagggggcaaaagcaccaaagacggggaaaatcacaaggtcacaagatatctcaaaagcctcacaatacgagttataccaatacaggctcaccagattgtaaatggaacgccgccggctcgcggttagctgcctgcctctcagacacggcgctttgcccagcttgacagggagtgagcctcacccaccccatcctcccaatccccctgagttccctcttcccaggcttcccctaaagggcctggactgcgtcattttcccaggaactgcagtgcccagcccaggacgtggtacagagtaactgtacattaaactggcagagcttgttagtggtaaaggtggtgagtccttgggtgcgcagtggagctgctctggggcctctgagcaagcagcagcctctgtctcacctcttcctgtcactgggagggccccttgggtctcgctgtgcctggacgccaggctctctgctttattctttcatccctgaggctccatcgctcagctcagtgctgactcagttcagaggattcttccctcaggaccgcagctcttgcagtgaataaagttttatgttccct

SEQ ID NO: 8367 - DNA, 1226 bp, Homo sapiens
  ENST00000639921
gtaccaggacctgctcaatgtcaagctggccctggacatcgagatcgccacctacaggaagctgctagagggcgaggagaaccgatagacatgcgcccctcccagataacactcaagccccttgcagacgtttggaactccagatagcacgttggctgctggggaaaaagctaggagatggagttagactttcctggcaaggaaaagggcgttcaagttgtcatgatggccccgcaccaagacccagcctaggggtgtcccaggcagcccgggcagccctctccctctgctttctttcaggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctagccagagcctatcataccagggtacttctaggtggggcttgcagctgcccctgtcctgctaggccctggtccctcttcccctccctgcaccccattcgacagcagaactgggtgagagcttgacatctgccctgtctgcagatccctgagcaagcactgcccttctgagtgttttctgtttttgtttttttaactgcttgtcactacagggggcaaaagcaccaaagacggggaaaatcacaaggtcacaagatatctcaaaagcctcacaatacgagttataccaatacaggctcaccagattgtaaatggaacgccgccggctcgcggttagctgcctgcctctcagacacggcgctttgcccagcttgacagggagtgagcctcacccaccccatcctcccaatccccctgagttccctcttcccaggcttcccctaaagggcctggactgcgtcattttcccaggaactgcagtgcccagcccaggacgtggtacagagtaactgtacattaaactggcagagcttgttagtggtaaaggtggtgagtccttgggtgcgcagtggagctgctctggggcctctgagcaagcagcagcctctgtctcacctcttcctgtcactgggagggccccttgggtctcgctgtgcctggacgccaggctctctgctttattctttcatccctgaggctccatcgctcagctcagtgctgactcagttcagaggattctt

SEQ ID NO: 8368 - DNA, 763 bp, Homo sapiens
  ENST00000592320
gagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggagtaccaggacctgctcaatgtcaagctggccctggacatcgagatcgccacctacaggaagctgctagagggcgaggagaaccggatcaccattcccgtgcagaccttctccaacctgcagattc

SEQ ID NO: 8369 - DNA, 1678 bp, Homo sapiens
  ENST00000586127
ctggaggttgagagggacaatctggcacaggacctggccactgtgaggcagaagtgaggaggggatggggaaggggggccttgtgagcagaaggggctgaatccccaagaaggagtgcccgagaagtctcagggaggggccgaacctccctgctccctgggcctccctacctcttgatggggcactatccttgccccccaacatgatgggagggaccagaaacaggcccagggccccggggatctgatgcccgcatgccttctgccaggagtccagggtcccctcagcacctccctactggggaaagcagtgcaggagcagcggggcccctgtgtttcattcatggctgggctttgtgactgtgggcagcgagctcacctattctgagcctgtgtccatataaaggaggagttggaagcggagaaggttgatgtccatgagggagattggattctggggtgaagaaagtgagggaaagagcaggcaggtctgggcgcaaagcacaggtgactgcctgccaccagcttgtgacccccatcaagttactttgacttgcacagctgtgaagcggtggtcataataaaattcatttcaaaaggtggttacctgggatcagaggaatccccaggggcatggcgcttcactgagctgacaggacatgcatgtgtgccttcaagtgcaggaggacatgtgcgtgtgtgtgtgtgtgtgtgcaacagtgagtgtatgcttgtggatgcgcctgtgtgagcagaagcaggtgcaccaaccctgataaggcaccttagtaatgagttaaggcaaaagcccacatctgctcatcctccagacaagtcctctgtctaaggccccccaacccttaatcctcctgctgctctactggtcctgggtgggggtggtctctgtgacagctgcctcaagggagactgaggcaggtattcaagtgtcctcagaagagcctggacccaggaatgtgtccccccactccaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagacc

SEQ ID NO: 8370 - DNA, 1018 bp, Homo sapiens
  ENST00000586793
agagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacggagtaccaggacctgctcaatgtcaagctggccctggacatcgagatcgccacctacaggaagctgctagagggcgaggagaaccggatcaccattcc

SEQ ID NO: 8371 - DNA, 609 bp, Homo sapiens
  ENST00000587997
cacagagattgcaactgagagagggagagacagagacagagaagctgagactgagagagacactcagagagaggagagaaacagagattggcaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcac

SEQ ID NO: 8372 - DNA, 1013 bp, Homo sapiens
  ENST00000376990
agagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctca

SEQ ID NO: 8373 - DNA, 585 bp, Homo sapiens
  ENST00000591719
attgacgtgcacccaaacatagtgcccgtagagaacaccacagctcagagcttatatgtagtgtgggagccaggaaagacactgtagagggggcatttgggctaggcaggacaggcacgctgtggacaggaagagaagaagggagggccattcctagtggaggacagagcctggaggcagaaaagcacagagaggcagggccccaagatgctagcctagccagggcacctagctgaggagtgtgagtggcagaagccactggtgtctgagcagggtgagggcccgatggggctgggaggacctccctgcaggcaggggagaaagggctattagaacccagggtgaggccaggcgaggtggctcacacctgtaatcccagcactttgggaggccgaggcatgcggatcacctgagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcac

SEQ ID NO: 8374 - DNA, 556 bp, Homo sapiens
  ENST00000590922
aacacagagattgcaactgagagagggagagacagagacagagaagctgagactgagagagacactcagagagaggagagaaacagagattggcaggtagagacaggaaatgaaagacaaacagaaagacactaagggagacggaaagagacaagagagcattcgaactcctggccgaggggcaggcagaagaggacacaatggcgtggggaaccccagctgtggcctgtaccctgagccctggtaccgcttctctcaccctggtcaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacg

SEQ ID NO: 8375 - DNA, 578 bp, Homo sapiens
  ENST00000588957
aaacacagctcactgcagcctcaacctactgggctcaagcaatcctccagcctcagcctcccaaagtgctgggattacaagcatgagccaccccactcagccctttccttcctttttaattgatgcataataattgctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggca

SEQ ID NO: 8376 - DNA, 787 bp, Homo sapiens
  ENST00000588316
ggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctg

SEQ ID NO: 8377 - DNA, 580 bp, Homo sapiens
  ENST00000585728
agagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatgg

SEQ ID NO: 8378 - DNA, 585 bp, Homo sapiens
  ENST00000588037
agcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagaatgtgtccccccactccaggctccaggatgaaaccaacctgaggctggaagccgagaacaacctggctgcctatagacaggaagcagatgaagccaccctggccc

SEQ ID NO: 8379 - DNA, 370 bp, Homo sapiens
  ENST00000593179
agcacagccccctaggggctgcccttgctgtgtggcgccaccggcggtggagaacaaggctctattcagcctgtgcccaggaaaggggatcaggggatgcccaggcatggacagtgggtggcagggggggagaggagggctgtctgcttcccagaagtccaaggacacaaatgggctggagtggcgcaaacacagctcactgcagcctcaacctactgggctcaagcaatcctccagcctcagcctcccaaagtgctgggattacaagcatgagccaccccactcagccctttccttcctttttaattgatgcataataattgagcgagcagagccagagcaggatggagaggagacgcatcacctccgc

SEQ ID NO: 8380 - DNA, 4921 bp, Homo sapiens
  ENST00000524240
aagacacacgcacgcagagacacacggtcactggaattccattagaaaaaagtgagccgagcaagggttagcgggagaagatttttttgaatcttgtcttcgtcttggtgcgaaagaagcgactccagtctctcgtcctcgaagctccgactggattgttcttgggcgctgacacccgtctgtggatttcttttctatttgcattttattccgaccccctccctcgccgcttccttccagcccttcactcgcaaatcgcctctctccccacctccccaggcccctcctgggaagcgcaggggaattggacccgcggggactcacgccttcccggacgattggaggggagggctgaccccaggactgggctgttggcttagaaagccgatacacagatacgcgtatatttgattgtagcgggcaaggggggcgtcgagaggcagcagcccatcgcccgcctctcaccccaccccctccagccagaggcgagaatcgcaggactcgggatcttcatcgggtggactagctgggatctccgcattggatttggggctgattaccactgcttgcctattattattgttgttgttactactattatttttttttacccaagggagaaagacaaaaaaacggtgggatttatttaacatgatcttggcaaacgtcttctgcctcttcttctttctagacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgagggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaactggccttgtaggctgtgggaaccgagtcagaatatttttgaaagctacgcagacaagaacagccgcctgacgaaatggaaacacacacagacacacacacaccttgcaaaaaaaaaattgtttttcccaccttgtcgctgaacctgtctcctcccaggtttcttctctggagaagtttttgtaaaccaaacagacaagcaggcaggcagcctgagagctggcccaggggtcccctggcaggggaaactctggtgccggggagggcacgaggctctagaaatgcccttcactttctcctggtgtttttctctctggacccttctgaagcagagaccggacaagagcctgcagcggaagggactctgggctgtgcctgaggctggctgggggcaggacaacacagctgcttccccaggctgcccactctggggacccgctgggggctggcagagggcatcggtcagcggggcagcggggctggccatgagggtccaccttcagccctttggcttcaaggatggagatggttttgccctccctctctgccctcgggtggggctggtgggtctgcagctggtgtgggaacttccccacggatggcggtggagggggttcgcaccgtgctgggctccccctgactgtagcacggagtgttggggctgggggccagctccaggagggcttgagagctcagcctgcctgggagagcccttgtggcgaggcattaaaacttgggcaccagcttctttctcggtggcagaaattttgaagtcagagagaaacggtcctttgttggcttctttgctttctcgtgggtcctttggcaggcctccctttggggagagggaggggagagaccacagccgggtgtgtgtctgcagcaccgtgggccctcaagctttcctgctgtcttctccctcctcctcctttcccctttctctttcctcatttcctagacgtacgtcaactgtatgtacataccggggctcctctcctaacatatatgtatatacacatccatatacatatattgtgtggtttcccctttctttcctttttttaagcaacaaaactatggaaataataccccaacagatgagcgaaaatgtattattgtaaagtttattttttttaatactgttgtctataatggggaaaaaggacattggccccgcagtgccctgccccagtcagcctggctgggctctggtgggggctcctgatccgcatccaagcttaaccaaggctccaataaacgtgctaggaagcaagctgcctctgcctcggtcccgtggggttttgcccccattttgttcttggtccagtgttacctgcgtaagtggagctcccagtgggctggggaaatgtgtgtccgtgtgtgtgcctgtgtgcatgtgtgtgcatccatgtgtctcacccatgtgtccacattgtgtgtagatggagctctcttaggagctggtttgacactgggggcgggatctgagggtccacgctgtgctgagcctggtgggctgttctgttccctctttgctcacttctccagttggcgcaaatgcctgtggctcccaggctggaagagaatgcagtggacgtggacgtggtggggagccacagcttggcatcacacgttgggaatgttttattgtcaggctgtctgggtggccctgttagtcttacatagagcaaagtggtatgtccctctgggactcctggcttatttgagatgtgtgattgtgagtgcagtgacctggccttttgggtcccaccagagaagaaggacatgactgtgcatgttctggggtcatggtctgaaagcataagtattttttgggtctccctctattccttcctttcctgtttctccatttgctacccaggccccacttggacactaggcctgccatagtctccaagagagattctccccagagaggaccaggagaatgcctgctggccaagtgtgtgtgtgtccatgtatgtgagcatgtgtacatgtgtgtgcggtcgtgtgcaggctcgcacatgttcacgtgcacgtgtgaatatatacccatggcaggagggagaatggaagactggtaggcgagaagatgtttctactgtcagcctggccttcagggctgcatgtgagcccatcccatttcaactggacaataggatgcagttttcccatctcccaatcgcaggtcccctcaatggcttttgcttctggttgtatatgtgtgagcagcatccgttcacagcgtttatcactgtggtgtattgccttccagcctctgcatggaaggggtacagtgagccagccaggtctctgtccagccattgcgggtagacgtggtcatggcatccacttaggaatccgtgttctttgcaaacagcaaagaccatttaacttaaaaagtactttactggaaggctatgggagaaggtggctcacggaatttgtgggaggtggggggaccaggggaggcgagggcagggactggagggcatctgaggggctggaaggcaggatgtacagggtcagcattctgctgccaaccattgcccatctggctgaactgggccttgtgcctgccctctgccatacttgagtgtgagagagaggatatatatgtcatgtctggtatccctaataggaggtaagcccttaggctacatcatgggggagagaaaatttcccaagaggaaactgaggtgccattatgaaggaggagtggatactagctagctttactctgccctcaaatgtctccctatccaagtatcacatggctgaaattttaccattaggtattcattcctttggttgagatgattcctatttgtgattctctcaaaatatgcaaatcgaactagaagaataaattgttgctatcttaa

SEQ ID NO: 8381 - DNA, 3558 bp, Homo sapiens
  ENST00000306793
ggagagagaaagacacacgcacgcagagacacacggtcactggaattccattagaaaaaagtgagccgagcaagggttagcgggagaagatttttttgaatcttgtcttcgtcttggtgcgaaagaagcgactccagtctctcgtcctcgaagctccgactggattgttcttgggcgctgacacccgtctgtggatttcttttctatttgcattttattccgaccccctccctcgccgcttccttccagcccttcactcgcaaatcgcctctctccccacctccccaggcccctcctgggaagcgcaggggaattggacccgcggggactcacgccttcccggacgattggaggggagggctgaccccaggactgggctgttggcttagaaagccgatacacagatacgcgtatatttgattgtagcgggcaaggggggcgtcgagaggcagcagcccatcgcccgcctctcaccccaccccctccagccagaggcgagaatcgcaggactcgggatcttcatcgggtggactagctgggatctccgcattggatttggggctgattaccactgcttgcctattattattgttgttgttactactattatttttttttacccaagggagaaagacaaaaaaacggtgggatttatttaacatgatcttggcaaacgtcttctgcctcttcttctttctaggcccagggccgctgctgaggaggaatggagtgcaaagggagaaaacttgctcctacatccaggggaggatgatgcctgagttctccctggggtatgaggagggctgtcccacagagtcgccttggtgtgctttggcgaaatgggtgtgacgttcccagcagggcccaagcccccaggcctgcatcttgggtgggagattgtggcggccgtcattcatgcttgtcttccctccccaccacccagacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgagggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaactggccttgtaggctgtgggaaccgagtcagaatatttttgaaagctacgcagacaagaacagccgcctgacgaaatggaaacacacacagacacacacacaccttgcaaaaaaaaaattgtttttcccaccttgtcgctgaacctgtctcctcccaggtttcttctctggagaagtttttgtaaaccaaacagacaagcaggcaggcagcctgagagctggcccaggggtcccctggcaggggaaactctggtgccggggagggcacgaggctctagaaatgcccttcactttctcctggtgtttttctctctggacccttctgaagcagagaccggacaagagcctgcagcggaagggactctgggctgtgcctgaggctggctgggggcaggacaacacagctgcttccccaggctgcccactctggggacccgctgggggctggcagagggcatcggtcagcggggcagcggggctggccatgagggtccaccttcagccctttggcttcaaggatggagatggttttgccctccctctctgccctcgggtggggctggtgggtctgcagctggtgtgggaacttccccacggatggcggtggagggggttcgcaccgtgctgggctccccctgactgtagcacggagtgttggggctgggggccagctccaggagggcttgagagctcagcctgcctgggagagcccttgtggcgaggcattaaaacttgggcaccagcttctttctcggtggcagaaattttgaagtcagagagaaacggtcctttgttggcttctttgctttctcgtgggtcctttggcaggcctccctttggggagagggaggggagagaccacagccgggtgtgtgtctgcagcaccgtgggccctcaagctttcctgctgtcttctccctcctcctcctttcccctttctctttcctcatttcctagacgtacgtcaactgtatgtacataccggggctcctctcctaacatatatgtatatacacatccatatacatatattgtgtggtttcccctttctttcctttttttaagcaacaaaactatggaaataataccccaacagatgagcgaaaatgtattattgtaaagtttattttttttaatactgttgtctataatggggaaaaaggacattggccccgcagtgccctgccccagtcagcctggctgggctctggtgggggctcctgatccgcatccaagcttaaccaaggctccaataaacgtgctaggaagcaa

SEQ ID NO: 8382 - DNA, 2104 bp, Homo sapiens
  ENST00000517328
gggagtggagccagcagctgagaccccggcaagggcaaccatggatctggagttggaacgggacaatgcgccatcaggccggcagaagctggcagatgagggccgagttgcggcacacaggtgccagatctccaaatagaggaaattggaaagaaaaagataaagctaatctgtaatttcatcacccggagacaactgctgttgacattgcattgtgtgtctaaggaggactttgacagggagaaagacaaaaaaacggtgggatttatttaacatgatcttggcaaacgtcttctgcctcttcttctttctagacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgagggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaactggccttgtaggctgtgggaaccgagtcagaatatttttgaaagctacgcagacaagaacagccgcctgacgaaatggaaacacacacagacacacacacaccttgcaaaaaaaaaattgtttttcccaccttgtcgctgaacctgtctcctcccaggtttcttctctggagaagtttttgtaaaccaaacagacaagcaggcaggcagcctgagagctggcccaggggtcccctggcaggggaaactctggtgccggggagggcacgaggctctagaaatgcccttcactttctcctggtgtttttctctctggacccttctgaagcagagaccggacaagagcctgcagcggaagggactctgggctgtgcctgaggctggctgggggcaggacaacacagctgcttccccaggctgcccactctggggacccgctgggggctg

SEQ ID NO: 8383 - DNA, 1503 bp, Homo sapiens
  ENST00000518077
gagaatcgcaggactcgggatcttcatcgggtggactagctgggatctccgcattggatttggggctgattaccactgcttgcctattattattgttgttgttactactattatttttttttacccaagggagaaagacaaaaaaacggtgggatttatttaacatgatcttggcaaacgtcttctgcctcttcttctttctagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaactggccttgtaggctgtgggaaccgagtcagaatatttttgaaagctacgcagacaagaacagccgcctgacgaaatggaaacacacacagacacacacacaccttgcaaaaaaaaaattgtttttcccaccttgtcgctgaacctgtctcctcccaggtttcttctctggagaagtttttgtaaaccaaacagacaagcaggcaggcagcctgagagctggcccaggggtcccctggcaggggaaactctggtgccggggagggcacgaggctctagaaatgcccttcactttctcctggtgtttttctctctggacccttctgaagcagagaccggacaagagcctgcagcgg

SEQ ID NO: 8384 - DNA, 1176 bp, Homo sapiens
  ENST00000517892
atgatcttggcaaacgtcttctgcctcttcttctttctaggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaactggccttgtaggctgtgggaaccgagtcagaatatttttgaaagctacgcagacaagaacagccgcctgacgaaatggaaacacacacagacacacacacaccttgc

SEQ ID NO: 8385 - DNA, 872 bp, Homo sapiens
  ENST00000522071
gccgtagccgggggagccagtcagtttccggccaaggcagcagggagaaagacaaaaaaacggtgggatttatttaacatgatcttggcaaacgtcttctgcctcttcttctttctagacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgagggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcg

SEQ ID NO: 8386 - DNA, 546 bp, Homo sapiens
  ENST00000519195
gtcactggaattccattagaaaaaagtgagccgagcaagggttagcgggagaagatttttttgaatcttgtcttcgtcttggtgcgaaagaagcgactccagtctctcgtcctcgaagctccgactggattgttcttgggcgctgacacccacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgagggtgaggagttctacgaagcctccccctatgagccggtgacctcccgcctctcggacatcttcaggcttgcttcaatcttc

SEQ ID NO: 8387 - DNA, 616 bp, Homo sapiens
  ENST00000520676
atgatcttggcaaacgtcttctgcctcttcttctttctagacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgaggagatggggtctcgttatgttgcacaggcctatctcaaactcccgggctcaagcagtactcccaccttggtttcccaaagttctgggcttacaggcggtgccttctccctagcaacctggattcctagaactagcatgagcaaagggaggaatactgtcctgagggtactgcactctattcttcaggagataaggcgctgtcttcacccagagccggactctgtagcgtacaaataattaaagcgctcaatgcctgagctga

SEQ ID NO: 8388 - DNA, 2128 bp, Homo sapiens
  ENST00000372134
ttttccgacagaggcctgcccgtgattggctgctcgtactatttacgtcctttcgatgttgcgtcatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatgattgctaagtgtttttttatttttgcatatttattgaactgtctaattgaatacagcttgctcttgtcacc

SEQ ID NO: 8389 - DNA, 4560 bp, Homo sapiens
  ENST00000230882
gcggcggcggcggcagcggcagcagcagctgctacagtggcggtggcggcggcggctgctgctgagcccgggcggcggcggggaccccgggctggggccacgcgggccggaggccccggcaccattggccccagcgcagacgcgaacccgcgctctctgatcagaggcgaagctcggaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacc

SEQ ID NO: 8390 - DNA, 566 bp, Homo sapiens
  ENST00000513671
tttgtgcgggccgcagccgcacgttggcaccgatggaactggggtcagtagagtgacagccaccagtccgcatgaactggggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaagatggggtccatgctcacatatcaagaaaatggagtcttacatgcaagcctaatgcagagtagagaagctcaccaacttgaaggaagcatgaatgaaattacaaggaaatctagcttagaaaaattaaccctgtagcttggtttttccactctttgctcttggcaaaaggatcttacgggaaaactggagcttagagaacttatgtaacattactagcaagttgcacagctgggattcaaactgaaatccagctagcttcaaagactgtgttctttctgctgctgcatactacccctacctaccaaggctctgagattagaaagcaggatgggtgtgt

SEQ ID NO: 8391 - DNA, 615 bp, Homo sapiens
  ENST00000505006
gaattcactgggcgcatcttacaagtaatttttggattctgcattgactacctacaagtgccttctgggtgcaagtccacaggcaagatttgttctgcaaatcttccatgaccaaggtcacctctttggattggcagacccagggagtccatattgggaagataaattcacacttcaccccttgttgagatctccagccttgctcctctgataaccagtttttggcatctcagatgaggaagagtgatgggcgacaggtgatggtgacaactattaataagatctgaaagtaaacagtctcatgaaaggtggccaggagagggcagtcaccttttatcaggagcacagactgaatttgcaaagggtcctacaggtatggatctctggcagctgctgttgaccttggcactggcaggatcaagtgatgctttttctggaagtgaggctctgaaatacctacttccaagagaacgaaatttattcaagaaatgttggatggaaattgaagagtgagcttggaaacgagacacagagtggcaggagcccagaccaacctgtttatgaaagatgcctttgcccatagagggaaaaatacaccttaaaacctctgccaaa

SEQ ID NO: 8392 - DNA, 2173 bp, Homo sapiens
  ENST00000511135
gattgcaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaagaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggt

SEQ ID NO: 8393 - DNA, 782 bp, Homo sapiens
  ENST00000513625
gtatcactgagcctttggctgagtctgatacagtccttatatacagacaatttttttttttccttgagacggagtcttactctgttgcccaggctggagtgcaatggcgcaatcttggctcactgcaaccgccgccccccaggttcaagcaattctcctgcctcagcctccagagtagctgggattacaggcatgcgccaccaagcccagctaattttgtatttttagatacagtttcaccatgttggtcagactggtctcgaactcctgacctcaggtgatctgcccacctcagcctcccaaagcgctgggattacaggcgtgagctaccgcgcctggccccatttaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcacctta

SEQ ID NO: 8394 - DNA, 4814 bp, Homo sapiens
  ENST00000615111
ggagagactggggaggtcgagctgtgcgcgtggacacagcgcgcagagcgcgcggtcttttgcgcgtttgtgcgggccgcagccgcacgttggcaccgatggaactggggtcagtagagtgacagccaccagtccgcatgaactgggttaaaatgagcaacttctttaaccagaactgaccttgaagacaaatggctaaaataaaacatttgctgaattcactgggcgcatcttacaagtaatttttggattctgcattgactacctacaagtgccttctgggtgcaagtccacaggcaagatttgttctgcaaatcttccatgaccaaggtcacctctttggattggcagacccagggagtccatattgggaagataaattcacacttcaccccttgttgagatctccagccttgctcctctgataaccaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 8395 - DNA, 4491 bp, Homo sapiens
  ENST00000618088
cctcttctcagctgatttggctgcctccattgtaataggcctcatgagactccagcctaggcctggccttcagttcagcaggcagagcccagagatgtactgggcaaaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 8396 - DNA, 4316 bp, Homo sapiens
  ENST00000357703
gtcctacaggtatggatctctggcagctgctgttgaccttggcactggcaggatcaagtgatgctttttctggaagtgaggattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 8397 - DNA, 4419 bp, Homo sapiens
  ENST00000537449
caatgatattagctatgacagcacgtatgagcctggggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 8398 - DNA, 4699 bp, Homo sapiens
  ENST00000612382
agatatgtgtgtgtgtgcatgagagagagagattgagaatgactgatttgggagggattttgtgaaggtttatatatcaaagcagaaagaccaagaatttagagattaatacatgccaagtggtaaccaagaaacttctgtgggatcccacctccaacccctccctctctgtcagattttaaccaaatcagtgtgatgtgatctgcttgcatatatgagtgaaagaaaaaggaaatttaaaaagttcttgatataaagcctggaggaaacaatacgaaaatccagcctctatttcagcaatatctgccggactattggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 8399 - DNA, 4312 bp, Homo sapiens
  ENST00000622294
gtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 8400 - DNA, 4529 bp, Homo sapiens
  ENST00000620156
ggagagactggggaggtcgagctgtgcgcgtggacacagcgcgcagagcgcgcggtcttttgcgcgtttgtgcgggccgcagccgcacgttggcaccgatggaactggggtcagtagagtgacagccaccagtccgcatgaactggggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 8401 - DNA, 4524 bp, Homo sapiens
  ENST00000612626
ggggaatgagtagcaaagatggattaagtgagaagagtataggaggcagcagggccagaggtgtgaatagcccagaaccttctgagaagattcctttgtggacggaagaaaggggaggtttgtggaaatggtggaagataaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 8402 - DNA, 312 bp, Homo sapiens
  ENST00000476882
agtgcgtccgagacgccgcgcggtgatgctcctgaaaacgtctgcccggcgtagcgggaacccagcatgattttcaggatcttatattgcactttaaacacacctaaaattgacatggaaagactcttaggaggacaactaggactagaagatttcatatttgcccatgtgaaaggaatcgaaaaagaagtgaatgtgtataaatctgaggattcacttggtctcaccattacagataatggtgttggctatgcttttataaagattcttatctgctgcctctgatagtgaaatgtgctgtgacttttctct

SEQ ID NO: 8403 - DNA, 3847 bp, Homo sapiens
  ENST00000370759
gctgggcgggcgggcggctgctccggtccaggggtggaggtcggggccctgacccgacgcagccaggcggaagcgcggctgccattggaggctgcttttacctgcgcggggcccggggcgcaaagtccgaggcgccggggggaggaggcggcggacggcagcgcaggtgggcccgcgctctcggccctgcaagatgcccctgaagctgcgggggaagaagaaggccaagtccaaggagaccgccgggctggtggagggcgagccgacgggcgcgggcggcgggagcctctcagcgtcccgggctcccgcacgcaggctggtcttccacgcgcagctggcgcacggtagtgccacgggccgagtggagggcttctccagcatccaggagctctacgcccagatcgcgggcgcgtttgaaatctcgccgtcggagatcttatattgcactttaaacacacctaaaattgacatggaaagactcttaggaggacaactaggactagaagatttcatatttgcccatgtgaaaggaatcgaaaaagaagtgaatgtgtataaatctgaggattcacttggtctcaccattacagataatggtgttggctatgcttttataaagagaattaaagatggtggtgttattgactcagttaaaacaatctgtgttggggatcatattgaatccataaatggagaaaatattgttgggtggcgtcactatgatgttgctaagaagttaaaggaattaaaaaaggaggaactctttactatgaagttaatagaacctaagaaggcatttgaaatagagctgaggtcaaaggctggaaagtcatcaggagaaaaaattggttgtggaagggcaacacttcgcctgagatcaaaaggtcctgccaccgtggaagaaatgccttctgaaaccaaagcaaaggcaattgaaaagattgatgatgttcttgagttgtacatgggaattcgagatattgatttagccaccacaatgtttgaagctggaaaggacaaagtaaatccagatgaatttgctgtggcacttgacgaaactcttggagactttgcgttcccagacgaatttgtctttgatgtttggggagtcattggtgatgccaaacgaagaggattatgatgtgtacactccatctctgaagaaacaacccatcgttcttttttttctcttttttaaaaagtcctataagatctgtttttggacacctttactaactctggtttaatttcatgtgtatggaatatattctttgaaatataattttggtaattttgatttctgggcactttttaacattgctgatgtagtatgcttaagagaaatgacctaaataaggatcaattgtaatattcattcaaaaggtttttaaaagtaagttttaaggagtatttctcgacagatgattttcttctccattaatacccatgctttgtttttcacatataaatagatgatttcaatagctttgtagttttttttcaaaatcttaatgtaaactaggattggagtatgatttacctcatagtatcttcactgtgttatcctagtttgaacaggatatgttcaggaaatgaaaggtgaattatgccccttattggtctagaagcattggtttttttttgatcctctgagtaagggaaggaagattcctgtggcatgttgatttctatggccaactttctctctttgtaaaacaaagattgattgattttcttgtatgcttctttatacatgctcttaaaacttgtggttgaaatctgtgctgtgtgtgtgtgtctctgcatgtgtaaaagaagggtaaaaaagagatgggtagggtagaactacttgcatttgatttttttttcagtccttaaaacattatttctttttttcactcatagccacttttatgttaccttttataagcactccagggaagattttatatttttttgtagagtttttggaaagatatttactcaaaataactatgctttagaactttttttttttttttttttttggttaaacagcagcactttttagttccctaaactttagaagaaatgctatcagaaatagatttccttccagtggaaagaaaggaggaagggagaattgagaaaatatattagtctattattttagagttctaatacactctaaattaaagagaaaattgagagtaaatgactgtcttatcactcttatttgacatttcgtaggtgtaagagaaatggaaatgaatggtttcaacaaagatcatttaatacagcagagcatggcatgaccaagcatctttgtaaagtgttagatggaaaatgctgtgtgctgccatggtaatcagaaataataacctgttagggatgtattctaggaaatcagaagtagttctcttttcttgctggattattgcttagataactcttgttttctggtaaaactttagttgtattgccatccactcctttttcaaatgagtttaatgccataaagctgatattctttgtccgattaatttgaaatctgcacagaagctgttttagtcattaatgtgtaacaaaagtagcttatagaatatggactgccttattgctgttgcttatcatttgaaaataaaatccagctcaggttgtaacttgttggtactcgtttagtgagttcgttttggaggttctgaaatacctattaattcttaatattacctctcttggaaagacacaaaaaaagagctgttatttttaggcataagatgacttaggaggcccatagaaacattctcgtttaaacaacaacaacaaaataaatttatcagcactagatattagatttgaaataagtcattgttcattattgatggttgtcagtttctccttcctttttgggcatgcataaagacacacttggtgctgattccatgtgatttatggaatgtcattttcacaatgatctttctagaatttgtgtgtaaggttgtgatatccatgtacagctgtaactatatatacttgtctgttagcattcagtggaccattatcattactatcatcacattacctgggcttcaactgggcccaagtactctatatactgcctgtaataggtttttccttgaaatatccttatctttcacctctacagctaaactgataacaaggtcagtttctttatgtcattttattcccatacctaaaattgcatctatttgtgagctttctgcctttttgtaacgctcagtgcaccaaaagcgtctgtttttagtgcagtcacataatatataagtgtgggatacccttctgcagcttcagtgagacaaatcactttttaaaaaacattccattttattggcatcactagatgtttttaggaccctgtccttttcacttttctgtaggctttttttttttaaatggaagatgattattttgtttgttcttgatttcctgttattgaaaacagcatcttccttcttgcaatggccactaatagcacacaatgcgttttctttgattgtagcagaaaatgcaaatgataattgtatgttgggctcgatgaggccttgaacatagctgagtcctaatcagatgtatatactctgatgattacaaataggtacatgttgggtttctgtgatgtttcaaaaatacaattatataattatgatgtaaactctttaagaattcaattataaaagcaataatcaggtaacctctatttggagctgctacatccaatattgtgactgaaaattaactaaagagagataatttttcaaatgatgtataatttgcaatattttcccttgcaactttagcaaatacacatattccaagtaaaacttta

SEQ ID NO: 8404 - DNA, 3289 bp, Homo sapiens
  ENST00000590918
ggcagcggtggcaggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtccctgcccttctggagatgacaactgagtggggaaaacagaccgtgaacacaaaacatcaagttccacacacgctatggaatggttatgaagggaagcgagaagggggcctagggtggtctgggaggcgtctccaaggaggtgacacttaagccatccccgaaagaggtgaaagagatcactttggggagagctggagaacaggattctaggcggaagcgatagcataggcaaaggcccttgggcaggaaggcgctcagccttggctggagtagaattaagtcagagccaacaggtggggagagacagagaagtgggcaggggcacccaagttgggatttcatttcaggtgcattggagattcttaggagtgtctcttgggggtaatattttattttttaaaaaatgaggatgtcactcttacccaggttggtcttgaactcctgggctcaagcaatcctcccaccacgggtctctcaaagtgctgggattacaggcgtgagccaccgcacccggcttttttttttttttttaaacggagtctcactctgtcacccaggctggagtgcagtggtgcaatttcagctcactgcaccctccacctcccgagttcaagcctcccgggtagctgggattacaggcaccgccaccatgcctggctaatttttgcattttcagtagagatagggtttctccatgttggccaggctggtctcgaactcctgacctcaagtgatccacccacctcagcctcccaaagtgctgggattacaggcataagccaccatgcccggcccaaatgggctaatgttttaaacagatccttcttgtctgccctgtaggaggacaaattatcaggggcaggggtggaagctggagcccagaaaggaggggactgcaggtgggaagtgatggtggctggaccaggatggaggccactgaggggtatgaagcagtcggatttgaagctgtttaaaaggtggaggtgagaggatttcatgaaggagcacatgaggacacagcagcagagaggactccttggctttggatggtggagagactaaagatagagagattgggttcgggtagggggagaaccacgtgtgctctttggaaaggttaggctggcagtgtttgtaggacatgacaggacactgagtgtaagggtctggagctctcaggagaggggcgagctggagatagtaatgtgagaggcactgggtcctgagagggtgatttggtgtggaccggagcacaggtgaggcaaggcaggcctcgcagctgaaactttatatccagagcagccagggccactgctggctgcggagtgaggacgcatatccccactgtccttagatgggtggcccctggaacctgggagaatgagggggcatgctgacagtctcattgtggctggaccacctgtacatacacccacaagaccctcacccctaaatcctccccctacacatatgcacacttaagttaccgtatgggtgttgtcgagcattttccctggggtctgtggctccctggaccgacatgccccaaagctgaactcagccttttcaagcttgcggccctgctgcccaattcccctacaccctgccttgtgggttctcgcggggtgggggccttagggcaaggctcttgtaaataaagtataagaaacagttgc

SEQ ID NO: 8405 - DNA, 1791 bp, Homo sapiens
  ENST00000263281
aggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtaggcagagacccggccgccgcccccgccctctggcggcagcgcggggtacggcgccgcctctgagcgccatcgtctcacaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtccctgcccttctggagatgacaactgagtggggaaaacagaccgtgaacacaaaacatcaagttccacacacgctatggaatggttatgaagggaagcgagaaggggg

SEQ ID NO: 8406 - DNA, 1432 bp, Homo sapiens
  ENST00000304207
ggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcagtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaact

SEQ ID NO: 8407 - DNA, 1414 bp, Homo sapiens
  ENST00000585889
ggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctgggattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtg

SEQ ID NO: 8408 - DNA, 557 bp, Homo sapiens
  ENST00000591322
tcctggcctcaagtgatccacccgcttcggcctcccaaagtgctgggattacaggcgtgagccaccgcgcccgggcccagattcgagttttgattatcgtttccactcccttttcttcccccaacaagtcctcctgataatttccagccaccccctccccaattttcttgaaggttttcagtctcccatagcaactccagtgggtggcttccaggcaccccaccccaagacttggaactggtttccaagctacccaagactcccgaacaacacgcaacagaccctcaaagtctctctggggcgcttctgggccacatggacctagcagcctgggagcgggggtcggtctgggggggtcctcccttctttcttttcctagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcct

SEQ ID NO: 8409 - DNA, 709 bp, Homo sapiens
  ENST00000588816
cctcaattttcccatatgtagaactaggttaaggatattactaattccatgggctagtatgaatattaaattaatacaaataacatgccatataagggtttatcatcatcatcatcatcatcatcatcatcaccacttcggctctctccctctctgttattgtctcacagtttgtctttctgtatttatctctttctctgtgtgccttaattccctctcttctttccccacagtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggtgggaccttaaccctgagtggtggcggcagagatgtgagctcggcctcagtttgtccagtaagatggggtggtctgtttccaccaggtccagctatccactggtggttctatggggagcagtgggggtggttaaaggagctctgtgtggccgggagcggtggctgatgcctgtaatcccagctctttgggatgccaaggcaggaggatcgcttgagcccaggagtttgagatcagcctggccaatatggtgaaaccctgtctctact

SEQ ID NO: 8410 - DNA, 782 bp, Homo sapiens
  ENST00000591224
taggaaaggttgtgttccagggcaatcggcaaggggagggggtggggcctggatcgtaatgggcgggaccttagagaatgtgtgtggtctcaagtgcggtgggcggggcctagcgagcaaatgagcttggtgatcggtgagtctagagtttttctatctcttagctctactccgccttccccaggtgctgggagcgcaacgaagtcaaggccatttggtggattatacggacccccatcctcatgaccatcttggtaggatcggtcccgcctccaccaggccgccctcagggatttcccattctgggaagtgggctgccacctcctcctgccccttcagaatgggatcgcggctggctcagcccttatctctccccacagattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccaggtgctcaggcagggtgcaggggctccatccttccacccagggcctcctccccagaggggcacgaaagctacagtcgttctctggtgcagccactgaatggggtgggaagatgggatttagttcgttcattaattaattcattcttttttttttttgagacggattctcgccctg

SEQ ID NO: 8411 - DNA, 153 bp, Homo sapiens
  ENST00000593127
agcgagcaaatgagcttggtgatcgattaatttcctcatttttatccgcattcttggcattctcctgtccaagctgaggacacggcaaatgcgctgccgggattaccggctgaggctggctcgctccacgctgacgctggtgcccctgctggg

SEQ ID NO: 8412 - DNA, 3037 bp, Homo sapiens
  ENST00000282561
gcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacata

SEQ ID NO: 8413 - DNA, 1587 bp, Homo sapiens
  ENST00000374029
gggctgggctgacagtacctggtggcatagggcagacacgcctgcagacattctctgggaaagggcagcagcagccaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaatg

SEQ ID NO: 8414 - DNA, 1904 bp, Homo sapiens
  ENST00000374022
ctggtggcatagggcagacacgcctgcagacattctctgggaaagggcagcagcagccaggtgtggcagtgacagggaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaatgaagaggtggcttgtgtgtttgtcaagttctttctcctgcaacctctgacctcccccaggatgagctggccttggttttttactgattaagaaaggaacagggcaaaagaagtagttacttgagtagctgaagctgcaaatgaggaaatcactgtacttctgggccgcagagccagccccggagccattcctccctgttgcttttgttgttgtggttcttgtctttttcattgtctaataacagctttattgggatttagtttacatacctccttcctctgattttgaaaagattaaaaatgacaactccctctgaa

SEQ ID NO: 8415 - DNA, 484 bp, Homo sapiens
  ENST00000447581
cagcagcagccaggtgtggcagtgacagggagacactatctgcagaagcacagggagcctgctgtagaaagacttctgtctcagatacattgtttcatcctacctatcctaccgctttggaacggtgtgaccttgaggagttacttatctgagcttcagcttcttcatctggaaaatgggataacaggcttcctaaatgggtcgaaagaaaaaatgtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagttt

SEQ ID NO: 8416 - DNA, 1637 bp, Homo sapiens
  ENST00000361726
atatgactccccagcaccgggcggtgatgaattgggacgcaggcgcggagcccagggaccactccccctgcacagacatgagaccataggggacctgtctgggtggcctcagggataggcgctccccaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaa

SEQ ID NO: 8417 - DNA, 2840 bp, Homo sapiens
  ENST00000339480
aaacagacaagcccaaggacaaggaagcagctactggacccaagaaggaataaggtagaccctgattttggaacctgaagaccaaagtgcaagattagctctgctacttccatctgtggaccattgggcaggtatctctgggccttcacttactctttgtgaaatgaggacaggggcaatccctaccctaccaagtcattgggagtgaagacatgatgacacggtgattgtgaaaagattttgtcaatcgcaccagcattaagggtgcccatctccaggttcccccaggcctcaaggctcccaaggcctgagtgggcaggtagcacccaggtatagaccttccacgtgcagcacccaggacacagccagcatgaactgggcatttctgcagggcctgctgagtggcgtgaacaagtactccacagtgctgagccgcatctggctgtctgtggtgttcatctttcgtgtgctggtgtacgtggtggcagcggaggaggtgtgggacgatgagcagaaggactttgtctgcaacaccaagcagcccggctgccccaacgtctgctatgacgagttcttccccgtgtcccacgtgcgcctctgggccctacagctcatcctggtcacgtgcccctcactgctcgtggtcatgcacgtggcctaccgcgaggaacgcgagcgcaagcaccacctgaaacacgggcccaatgccccgtccctgtacgacaacctgagcaagaagcggggcggactgtggtggacgtacttgctgagcctcatcttcaaggccgccgtggatgctggcttcctctatatcttccaccgcctctacaaggattatgacatgccccgcgtggtggcctgctccgtggagccttgcccccacactgtggactgttacatctcccggcccacggagaagaaggtcttcacctacttcatggtgaccacagctgccatctgcatcctgctcaacctcagtgaagtcttctacctggtgggcaagaggtgcatggagatcttcggccccaggcaccggcggcctcggtgccgggaatgcctacccgatacgtgcccaccatatgtcctctcccagggagggcaccctgaggatgggaactctgtcctaatgaaggctgggtcggccccagtggatgcaggtgggtatccataacctgcgagatcagcagataagatcaacaggtcccccccacatgaggccacccaggaaaaaaggcaggggcagtggcatccttgccgtagcagggtggtgaggagggtggctgtgggggctcaggaagctcgcccaggggccaatgtgggaggttgggggtagtttggtccctgggtcctgagcctcaggggagggaggttgatagctactggggattttgtatatggcaacagtatatgtcaaacctcttaataaatatgattttcccagtactttgcagaccaggtggggagtggccgataggaaaacggggggcaggggggattaggtggacctcagagaggatgccaagactactcagtgagcacctgagcactggaacctcagatccaggctcacccatcaccccccaacacacacagtgtgtgcccccagaacatgatgggctgtgcccaaaggcagaggctactccaggggcctctgggttgtgcaaccacctggccaaagcaggaggagaggaattccaggagaccctgtgcccagcaggagtcagttctcagtgatcgtccatcacaggaatgagcgtgggttgggcctccctagccctgcccagcacaggtcccggataggtgagtcccctctgacggtgggagggtcacggctgagagcaagccagggatgggaatctgtcaaggtgcccaagaggcacatcctacaggccagggcccactgagagtgtctgagctgaaaggtcccttgtggatcctggagtctatggaatttcatgttctttttcactgatacaacttccccatcccatactcccccaccccaccaccactcagactttggcaactcccagaaccacacctccaccctaacatgcctctgagtcccaccaaatgcccactagacaattccctgggaggcccccaggcatctcatacccgccactcccaagctgacctcatcagctcacccagacctgcccccttgaagatgccccaccccatctcatgcaggacacagctattcacccagctgcccaagccaggggacgagacaagcctgacatccttgtccctcacaccccacacccccactggcaccaaatcccactgattccagtccctaaatgccacctgaatctgctcttcctctccttacaacaacctaactacctcctggacctcccccatctgccctccgctacagggatggagtgatttatctgtctatgcaactgaccatgtcattccacctgctttaaaatttcttccaccatcaccagccccatgccctcagcatggcccccgctgacctccccacctcatcccagcttcctccccttttctacctgcaagtaataccaaagggctcctggttccccaggcagacacgtcatgtggtgtcattcctcgtgcctttgtcatgctatttcctctggctagaatgcccttcccaccccctctgtgatcctccctcgaacctctaggacagctttacccatctctctaagtgccagcctcgcttgtccctctgccactctccccaaatcggaattgtcacttcccctgagtgtctccctatcagtctgtgagcccttaatgggcaggtcactgagtcatccaggtccctgctgccttcaataaatgcttgttagatgagt

SEQ ID NO: 8418 - DNA, 1808 bp, Homo sapiens
  ENST00000241124
acataactgggggtgtggagagcgcctcattgccactgcagtgactaaagctgggaagacgctggtcagttcacctgccccactggttgttttttaaacaaattctgatacaggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaaccagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaaggcttttttaactcatccgtttgccaatcattgcaaacaactgaaatgtggatgtgattgcctcaataaagctcgtccccattgctt

SEQ ID NO: 8419 - DNA, 1927 bp, Homo sapiens
  ENST00000400066
acgagagcccgacagccggcggcgcccgagcccgacctgcctgcccagccggagcgaagggcgccgccccgcgcagagcccgcgccagggccgccggccgcagagcagttaaaacgtgcaggcaccagaaggcacttcctgtcggtgaagaagacctgtctccggtgtcacgggcatcctgtgttttgcaaacggggctgacctcccttcctggggagcaggaagggtcagggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaaccagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaaggcttttttaactcatccgtttgccaatcattgcaaacaactgaaatgtggatgtgattgcctcaataaagctcgtccccattgctt

SEQ ID NO: 8420 - DNA, 1805 bp, Homo sapiens
  ENST00000400065
cgacgagagcccgacagccggcggcgcccgagcccgacctgcctgcccagccggagcgaagggcgccgccccgcgcagagcccgcgccagggccgccggccgcagagcaggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaaccagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaaggcttttttaactcatccgtttgccaatcattgcaaacaactgaaatgtggatgtgattgcctcaataaagctcgtccccattgctt

SEQ ID NO: 8421 - DNA, 2131 bp, Homo sapiens
  ENST00000356192
ccgcagcccgcccgagccgcgtcagggcagaggcggggtggggcgcggttaaaaggcgcagcaggtgggagccggggccttcacccgaaacccgacgagagcccgacagccggcggcgcccgagcccgacctgcctgcccagccggagcgaagggcgccgccccgcgcagagcccgcgccagggccgccggccgcagagcagttaaaacgtgcaggcaccagaaggcacttcctgtcggtgaagaagacctgtctccggtgtcacgggcatcctgtgttttgcaaacggggctgacctcccttcctggggagcaggaagggtcagggaaggaaaagaagtacagaagatctggctaaacaatttctgtatggcgaaagaaaaattctaacttgtacgccctcttcatgcatctttaattcaatttgaatattccaggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaaccagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaaggcttttttaactcatccgtttgccaatcattgcaaacaactgaaatgtggatgtgattgcctcaataaagctcgtccccattgctt

SEQ ID NO: 8422 - DNA, 1840 bp, Homo sapiens
  ENST00000636852
ttttctcttattttaaaaatcaagatatttgcccttctccaggaattgggcccctcttttcattctgaataataatattctgctctcctgtggaaatgcttaaagaattgaacatagaataaccatgagatccagcaatcccacatctagatacctaagagacttgaaagcagggtcttgaaaaaatagtagtataccctcactcacagtagtgttacaacagccaaaagctggaagcaacccagtgtccattgatagatgaatgggtaaacaaaatggggagcatccatacggtggaatagtattcagcctccaaaataaggaaatcctgtcacacgcagcaacatggatgaacctcgaggacattatgctgagtgaaataagccagttccagaaagacaaggataaaccagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaa

SEQ ID NO: 8423 - DNA, 2243 bp, Homo sapiens
  ENST00000366714
ggggaacaatggggcccttgagggcccctcctccagcccccattgtgcttggtggtgagaggtggccctggctcggccacacaccctcggggaggaccagcatccaagcaggtggaagggctctgagggagactggaattttctggcctggagaaggacccgcccgcccgcccctatgaccaacatgagctggagcttcctgacgcggctgctggaggagatccacaaccactccaccttcgtgggcaaggtgtggctcacggtgctggtggtcttccgcatcgtgctgacggctgtgggcggcgaggccatctactcggacgagcaggccaagttcacttgcaacacgcggcagccaggctgcgacaacgtctgctatgacgccttcgcgcccctgtcgcacgtgcgcttctgggtcttccagattgtggtcatctccacgccctcggtcatgtacctgggctacgccgtgcaccgcctggcccgtgcgtctgagcaggagcggcgccgcgccctccgccgccgcccggggccacgccgcgcgccccgagcgcacctgccgcccccgcacgccggctggcctgagcccgccgacctgggcgaggaggagcccatgctgggcctgggcgaggaggaggaggaggaggagacgggggcagccgagggcgccggcgaggaagcggaggaggcaggcgcggaggaggcgtgcactaaggcggtcggcgctgacggcaaggcggcagggaccccgggcccgaccgggcaacacgatgggcggaggcgcatccagcgggagggcctgatgcgcgtgtacgtggcccagctggtggccagggcagctttcgaggtggccttcctggtgggccagtacctgctgtacggcttcgaggtgcgaccgttctttccctgcagccgccagccctgcccgcacgtggtggactgcttcgtgtcgcgccctactgaaaagacggtcttcctgctggttatgtacgtggtcagctgcctgtgcctgctgctcaacctctgtgagatggcccacctgggcttgggcagcgcgcaggacgcggtgcgcggccgccgcggccccccggcctccgcccccgcccccgcgccgcggcccccgccctgcgccttccctgcggcggccgctggcttggcctgcccgcccgactacagcctggtggtgcgggcggccgagcgcgctcgggcgcatgaccagaacctggcaaacctggccctgcaggcgctgcgcgacggggcagcggctggggaccgcgaccgggacagttcgccgtgcgtcggcctccctgcggcctcccgggggccccccagagcaggcgcccccgcgtcccggacgggcagtgctacctctgcgggcactgtcggggagcagggccggcccggcacccacgagcggccaggagccaagcccagggctggctccgagaagggcagtgccagcagcagggacgggaagaccaccgtgtggatctgagggcgctggcttgcgagctgggccagggaggaggagggttggggggctccggtggaaacctgcgaccccttctcctcagccttctccttagccggtggcctcaggcagactctgcccagaggggcagccaggctgctcagggaaggggctgaaagcggcagaggagtgccctggcttggtcaccactggggccaaggtggggtggagagaggcctaggagccagaaagggccctctgctgtggtctgaaccccagggggagtggggcattgactccacccctgtcctgagctggaataggtcctctgggatgccagctctcccctttgtgcttccctgcagcaacccatggagggcccagggtgcctggtatgggcatcagttggtgggggtgcgggggtgcgtgtccccattccctgcaacagcaaatggggctccttcttcagccctccccttcccagccccaaactgagacagactgggagctgggagcctggggtggacaggaccataccctctttgagcttctgcgatgccggccttccgttcctctgggaggcttgaagttctgcaaagatgttgatatgccttgcagcttggacccaatgggtggtggtcagggcctgggggcttggccatgctgggggaatggggctctgggttcctgcctgtggcctgtctgtcctcctccctaattcagacccagcctcaagaggaaagggagtaaaataaaactaacttgtttataa

SEQ ID NO: 8424 - DNA, 1116 bp, Homo sapiens
  ENST00000312891
atgtgtggcaggttcctgcggcggctgctggcggaggagagccggcgctccacccccgtggggcgcctcttgcttcccgtgctcctgggattccgccttgtgctgctggctgccagtgggcctggagtctatggtgatgagcagagtgaattcgtgtgtcacacccagcagccgggctgcaaggctgcctgcttcgatgccttccaccccctctccccgctgcgtttctgggtcttccaggtcatcttggtggctgtacccagcgccctctatatgggtttcactctgtatcacgtgatctggcactgggaattatcaggaaaggggaaggaggaggagaccctgatccagggacgggagggcaacacagatgtcccaggggctggaagcctcaggctgctctgggcttatgtggctcagctgggggctcggcttgtcctggagggggcagccctggggttgcagtaccacctgtatgggttccagatgcccagctcctttgcatgtcgccgagaaccttgccttggtagtataacctgcaatctgtcccgcccctctgagaagaccattttcctaaagaccatgtttggagtcagcggtttctgtctcttgtttacttttttggagcttgtgcttctgggtttggggagatggtggaggacctggaagcacaaatcttcctcttctaaatacttcctaacttcagagagcaccagaagacacaagaaagcaaccgatagcctcccagtggtggaaaccaaagagcaatttcaagaagcagttccaggaagaagcttagcccaggaaaaacaaagaccagttggacccagagatgcctgagttggagatgaactttggccaactttcctcatcaccatacttaaaatcctgtccaaggaggagcttattcaccattttctatacatgtgacatatgtagcagcataaccgacaactgggactgcgctgccttgactccacctctacatacaatgactcagctaaccagactaataaaagccatgtttgcaccattgctcagggaggcattgctttggggaattattcccagtgtcctccttacttatcgcaagtaataaaatccccctgggaaatc

SEQ ID NO: 8425 - DNA, 2889 bp, Homo sapiens
  ENST00000290374
gctcggccctggcctcgcaggctgccgcgccggagcgccaggtgcccgctgaagtagcaggaacagagccggtgttcggaccctcccctggcccccaacctgcggcggagagcggcgctgagacttctcctgggcgggcgagcgctggaggacctgcaggctgccaccccgccccgcccctcgtcccggcgtccgcgggatccagacccgaaccccggacggcgcccgaggttcgtgccctctctctagaccgcgccaactgccccatcggtcgggacgcgcttggatttctttccccatttcttctcttttaagtacaataaaaggaaagggggattcgaggattttttaaaaaattgcttctttaattgggaggcaattcactcccattctggaagtgcggcccggggaggggccaggagcgggaacgtgcccggtgctgcccagtctttgtctgctgcctccggatgcacagcgatgggggaatggaccatcttggagaggctgctagaagccgcggtgcagcagcactccactatgatcgggaggatcctgttgactgtggtggtgatcttccggatcctcattgtggccattgtgggggagacggtgtacgatgatgagcagaccatgtttgtgtgcaacaccctgcagcccggctgtaaccaggcctgctatgaccgcgccttccccatctcccacatacgttactgggtcttccagatcataatggtgtgtacccccagtctttgcttcatcacctactctgtgcaccagtccgccaagcagcgagaacgccgctactctacagtcttcctagccctggacagagacccccctgagtccataggaggtcctggaggaactgggggtgggggcagtggtgggggcaaacgagaagataagaagttgcaaaatgctattgtgaatggggtgctgcagaacacagagaacaccagtaaggagacagagccagattgtttagaggttaaggagctgactccacacccatcaggtctacgcactgcatcaaaatccaagctcagaaggcaggaaggcatctcccgcttctacattatccaagtggtgttccgaaatgccctggaaattgggttcctggttggccaatattttctctatggctttagtgtcccagggttgtatgagtgtaaccgctacccctgcatcaaggaggtggaatgttatgtgtcccggccaactgagaagactgtctttctagtgttcatgtttgctgtaagtggcatctgtgttgtgctcaacctggctgaactcaaccacctgggatggcgcaagatcaagctggctgtgcgaggggctcaggccaagagaaagtcaatctatgagattcgtaacaaggacctgccaagggtcagtgttcccaattttggcaggactcagtccagtgactctgcctatgtgtgagagggcaggtttcatgaaggtctgggggatggcaaggagccccaaggcagatgactgctcagacgtggctgtatccaccctcatttatgtgaccctcaccattaagatgtaggataagactggataaaagaagattttgcaccaatgggaaaggaggaaaagtggacccattttcacatatcacctaattggttctacagagacgattgggtagagtgatgaaatggatcaattagacttctttggtccctttctgtttatggcctagcctgatcctgataacactgaacttgcacagctaccaagtaggacttagccctgctgagctctttattctggtgaatggtgtgagttgagtacttcattgatataaaatttgtgacctatctcaacccatccctttatcctgagccatgggacaaacatccttgaggcactcttcatgtatctcccccaccagcatgcccctttccctcaatccaaaatagcatgccagctttttttttttttttttttttttttccagaatctggccttacattagacctaatatgttttatttgcaaacttagagggaattacatggggtgcttattggagaacggccatggcagaggttttcattagagccccatctgactggcccttagtcgtgatgaaaaccttaggaatgtctcaatatttccagttttctaactcaaactgcactggtgctgtttactagggatgggggatgggtgggagggagggaattgcaatatgcaactacaacacttttgtgagattgttgttgcacagttaggcacacggttacgagcttcaggatatttctgccttccagcttgtggactttggttaacattaaaaagattttttttggctaatatcaagagtgtctagctgagccacagcatttgtaactggtgtatctcactcattttcttacatagttttgttgtgcaacacagctgcacggtcattttgccatgatttgaatttacctgtgtgcttacaccagagaccttaatcatcccatgtcaatcctgatttattattttttcagttactctttgaaacacacacacatatacagacacacatacaaaattactggcttaaaagacctgcaactaaacactattggctaacgtgtgtttacggtgacttatttgagacatataccaaaggttcaaaaacctattgcattggactgtcaatatgttttcttctttttgctcttatttatttaagtgccatactgtacctttcatatccactgtgtatttagttaaaatattggccaagagaaacatctgggtaatgtgcttttatgaagccctttgttccctttgaattatcattatcatttttgatttagatatggacatggtgtaacacacaactaaggatttgtttaaaataaagttcttgcctttttttgtaaaa

SEQ ID NO: 8426 - DNA, 4170 bp, Homo sapiens
  ENST00000265113
gctttatttttcaattcttcctagtcccggttttgcatttctaatgacagtgaactgacaaagcgtgaaagtggtctaaggagcaaaacaaagccagcaagcctgcttctggtgtgccaagattaatcaatattccagaaacctcggggtttccccctcctccctgtgcggtttccattccccactcctcctttcccgggcacagactcctccccttttcttaagttgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacattaa

SEQ ID NO: 8427 - DNA, 784 bp, Homo sapiens
  ENST00000513903
aaaacaaagccagcaagcctgcttctggtgtgccaagattaatcaatattccagaaacctcggggtttccccctcctccctgtgcggtttccattccccactcctcctttcccgggcacagactcctccccttttcttaagttgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagtcatttgcgaggagtcctttggtttccagttacctcccccacaggcgcacacgctggctgcttgcgttggcagcgacacacatccatgttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatct

SEQ ID NO: 8428 - DNA, 583 bp, Homo sapiens
  ENST00000504121
acatgcacactgtcagggctagcctgcctgcttacgcgcgctgcggattgttgctccgttgtacctgctggggaattcacctcgttactgcttgatatcttccaccccttacaaaatcagaaaagtcatttgcgaggagtcctttggtttccagttacctcccccacaggcgcacacgctggctgcttgcgttggcagcgacacacatccatgttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtgagtcatttgattaaaaacaaaaaaacctgtatcttgtttctctggggcatctggctgcccggggaatattatcagatgaactagttgtagg

SEQ ID NO: 8429 - DNA, 1096 bp, Homo sapiens
  ENST00000512374
acatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtgagtcatttgattaaaaacaaaaaaacctgtatcttgtttctctggggcatctggctgcccggggaatattatcagatgaactagttgtaggtatcaaaatggtagcctaggctttcctctgaacttgatgatttttctccataaaaatgactgttttggcttgtttggagcaatatatagtaaacacatcattaggcatcattaggcattatgcaaatcaattgtgtgaggaagaaaaataaataaaatattttcccatttcatgtaaggataaggaagtgatcatttaatcattaggcatgacaaagcaagcatgctagatttggccaaaatgtaattatatacaatgtcagttgcacttaaaactaatttatacaattagtacacctaaaatgacatgttggttccaaatagtaattatattctaactggtgctgacttgaagctgagtatcaacgcttaggcacagagaccgaatattttatgtgtttgcactctctcacccagcaactgggaaaggtagattggggaaaatgttaacacagatctctttcattcattgctttgcagagcctgccataaccagctatacctttttttgaatcatttccatctcttactaatttagcagggttgacagcaatctgtactaataaaatattattgttttgttttgtttattgatcttaaaa

SEQ ID NO: 8430 - DNA, 558 bp, Homo sapiens
  ENST00000416645
acactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtggatgaaaaaactgaagcccaaatccttaccacacagctgatgaatactgagtgggattcaaatccaccattccggctccaggtgctcattcaccacactgttctgggtgctataacacccattctggctttactccagcaatttgctgagggtctgcctgaggt

SEQ ID NO: 8431 - DNA, 1137 bp, Homo sapiens
  ENST00000506725
acactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtggatgaaaaaactgaagcccaaatccttaccacacagctgatgaatactgagtgggattcaaatccaccattccggctccaggtgctcattcaccacactgttctgggtgctataacacccattctggctttactccagcaatttgctgagggtctgcctgaggtagcaacggaagagatggaaaagagaggtcgaactgaaagcccactggtgagacttggcaattgattcaatgagagaaggtggactgcagaccaatggcccgctttctggtttaggtggcagagtggctgatgatgccacatttgaaggtaggatacaggagaaagactggggccttgggggtgcacgagggtaagttcagtttggacctgttgagtttgtggggcgggatgccaccgaggtgcatatacaatggaagaagcttgctgcaaatcaagatttagaaggtattcctacaacctccaaactgaacgaagacagttctgtctttggatttcaagtgaataaggatcagtgaatcgggctatcctactgcataaatgagtctactctgtaagtgagtctattctcagaacagtttccgtaactctagggccctctccttcatgcttaaaagcactaatctttcagaaatgctgtagtggtgttctgtgcctggacgtaactgaccaagccagttaggtcagccaagcaggttaatcaatgtggtttgctatcagctgctggactgaactgacctg

SEQ ID NO: 8432 - DNA, 540 bp, Homo sapiens
  ENST00000505202
ggtgtctgtttatgccgggtccgctgttaattcggagttgagtcattcggggtggattgggggcagattgtggcgcgagatctagaaaaggatcaaggttgagcggatctgcttaaaagtgactgttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacagg

SEQ ID NO: 8433 - DNA, 566 bp, Homo sapiens
  ENST00000513646
acactgcaaccttgaggtctggtattgtggctctccagtccttgattcctgctgagattatgcaatttgccaagagcttgcctggtgtggagcagcactgatttctcacccctggaggctataactcatgtctctttttctcccattctagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacagg

SEQ ID NO: 8434 - DNA, 414 bp, Homo sapiens
  ENST00000502864
cgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacagataacatctggttggacagcctattagctattgatgcaagaatgcttgttctcagaaccaccaggacttgagcgggagccttcttggaagcctcatcaagagcacatctctgacttggagaaggaatttccatagacactgcccgagcaggatgatttctg

SEQ ID NO: 8435 - DNA, 540 bp, Homo sapiens
  ENST00000514563
accattccggctccaggtgctcattcaccacactgttctgggtgctataacacccattctggctttactccagcaatttgctgagggtctgcctgaggtagcaacggaagagatggaaaagagaggtcgaactgaaagcccactggtgagacttggcaattgattcaatgagagaaggtggactgcagaccaatggcccgctttctggtttaggtggcagagtggctgatgatgccacatttgaaggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaag

SEQ ID NO: 8436 - DNA, 545 bp, Homo sapiens
  ENST00000509272
gtaagttcagtttggacctgttgagtttgtggggcgggatgccaccgaggtgcatatacaatggaagaagcttgctgcaaatcaagatttagaaggtattcctacaacctccaaactgaacgaagacagttctgtctttggatttcaagtgaataaggatcagtgaatcgggctatcctactgcataaatgagtctactctgtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcagg

SEQ ID NO: 8437 - DNA, 567 bp, Homo sapiens
  ENST00000505376
actgacactgctgatgcctcaccattctagcctcggccttttcccttcaccttgtgagatttggggccaggttctcacaacatgaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgag

SEQ ID NO: 8438 - DNA, 547 bp, Homo sapiens
  ENST00000506178
agaactaccaggacactcagctgatgtgccctatttcactgttctcagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaa

SEQ ID NO: 8439 - DNA, 3832 bp, Homo sapiens
  ENST00000612708
gctttatttttcaattcttcctagtcccggttttgcatttctaatgacagtgaactgacaaagcgtgaaagtggtctaaggagcaaaacaaagccagcaagcctgcttctggtgtgccaagattaatcaatattccagaaacctcggggtttccccctcctccctgtgcggtttccattccccactcctcctttcccgggcacagactcctccccttttcttaagttgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacatt

SEQ ID NO: 8440 - DNA, 3652 bp, Homo sapiens
  ENST00000381918
ttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacatt

SEQ ID NO: 8441 - DNA, 4030 bp, Homo sapiens
  ENST00000613445
gctttatttttcaattcttcctagtcccggttttgcatttctaatgacagtgaactgacaaagcgtgaaagtggtctaaggagcaaaacaaagccagcaagcctgcttctggtgtgccaagattaatcaatattccagaaacctcggggtttccccctcctccctgtgcggtttccattccccactcctcctttcccgggcacagactcctccccttttcttaagttgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacatt

SEQ ID NO: 8442 - DNA, 4170 bp, Homo sapiens; identical to SEQ ID NO: 8426
  ENST00000265113

SEQ ID NO: 8443 - DNA, 784 bp, Homo sapiens; identical to SEQ ID NO: 8427
  ENST00000513903

SEQ ID NO: 8444 - DNA, 583 bp, Homo sapiens; identical to SEQ ID NO: 8428
  ENST00000504121

SEQ ID NO: 8445 - DNA, 1096 bp, Homo sapiens; identical to SEQ ID NO: 8429
  ENST00000512374

SEQ ID NO: 8446 - DNA, 558 bp, Homo sapiens; identical to SEQ ID NO: 8430
  ENST00000416645

SEQ ID NO: 8447 - DNA, 1137 bp, Homo sapiens; identical to SEQ ID NO: 8431
  ENST00000506725

SEQ ID NO: 8448 - DNA, 540 bp, Homo sapiens; identical to SEQ ID NO: 8432
  ENST00000505202

SEQ ID NO: 8449 - DNA, 566 bp, Homo sapiens; identical to SEQ ID NO: 8433
  ENST00000513646

SEQ ID NO: 8450 - DNA, 414 bp, Homo sapiens; identical to SEQ ID NO: 8434
  ENST00000502864

SEQ ID NO: 8451 - DNA, 540 bp, Homo sapiens; identical to SEQ ID NO: 8435
  ENST00000514563

SEQ ID NO: 8452 - DNA, 545 bp, Homo sapiens; identical to SEQ ID NO: 8436
  ENST00000509272

SEQ ID NO: 8453 - DNA, 567 bp, Homo sapiens; identical to SEQ ID NO: 8437
  ENST00000505376

SEQ ID NO: 8454 - DNA, 547 bp, Homo sapiens; identical to SEQ ID NO: 8438
  ENST00000506178

SEQ ID NO: 8455 - DNA, 3832 bp, Homo sapiens; identical to SEQ ID NO: 8439
  ENST00000612708

SEQ ID NO: 8456 - DNA, 3652 bp, Homo sapiens; identical to SEQ ID NO: 8440
  ENST00000381918

SEQ ID NO: 8457 - DNA, 4030 bp, Homo sapiens; identical to SEQ ID NO: 8441
  ENST00000613445

SEQ ID NO: 8458 - DNA, 3566 bp, Homo sapiens
  ENST00000389887
gcggccctagtggctggtctttcctgtgcttgggatgttggccttgtagagttacttctgtaatctcaagacagaaactgacagctttgtttgatcaaaattgttacttcaccttgcacattttcaagagttctacaggtttaatgagcacagaaatctgggggaactttcactctccagggctccttcatagaggttctcaaatactccatcagcagaggggagccccagatggcaaaaggacacaggatatgtcatctttcaaatgaaccaataatccattatttgattcttctacctttgtcaaaattcctccagcaacgcctgcagaaaatcacaattcttgatacatagcttgttccaataaagcaccacagcatttctagtgactgcaggcccagctgtcaaactctttcaacttgatagagaatatgtacacaaaacctatagctgtcatcatacttaatagtgaaaaacagaatgttttccagctgacactggggacaaggtaacagtgtcagttcctgccgctcttattcaacacagaaattttagtcatcatactaagacacacaaaaaaaggaataaaaagccacgcagactggaaaggtagaaataaaactctccatatttgcagatgacatgattatctacatggaaaatgccaagtaatacacaaataacctcttaaaattaataggtgagtttgccaaggtcacaggatatgagatcaacatgagaaacacaatcacatttctgtatgctaacaacaaacatgtaaaaactgaaataaaaataataacagtttaaatctcttgagagcaaaggaaatatttaagtataaacctaacaaaacgtgataggatctgatgttgaaaaaatcacacaattctgatgaaagaagtgaaaaaaaaaaaactatttaaatagacagacataccatgttcgtgggttggaagattcaacataataaggatacaattctcaatttgatccataggttgattgcaattcctctcgaaataccaacatggctttttgtagaaacagacaagtttattctaaattttatgtgggaaggcacaagccctagaatactttaaacttgacaaagaagaataaagtgtgtggctgtaaaaccaaactgtaaaaaattaacagttcattgcttgcagtcgaaaaaatgaggaaaagatggacgatctaggaaactttcagggagctaaggtgtcggagagcaaagtatccttgtaaggaatgagacaagataaactccctcccccacacacagtattttcagagaactacattcttggtttcaacctgatgtcataggctgtgttctttgcaacggaagaagcaaagacttcaaagggagaaatcggaagatttcttttttcatcgtagggacttcacatcagcgtttccaaaaccgagtccatcgccttttccctctgcgcagcctctatcccttcctgtgtttcgcatctcaataaacgtccccgccaagtgacttcagcctgaaacatgcggcctcccggactcctctctgtgtcaccgacctcttgcgctcagttctccggagctgccggtttaacctcgcaagtcttcccggaacccgtgccctcctcctgggcagcgttaccaccacgagcgcctacctgagaggacgcctgttctcatccagcctccaccctgcagccgagcaatctccgtaaaacgaacacctggcttagtttctgctggaaaccgttgaatagtccccactgtcttctggaagggtctgggcagctcggcgtggcgtccacggccccaccaggcctctgcctcctgcaggtcccgctacttcgtcaccaaagcgcccgccgcgctcgcatctgctgtgaggctgtgctcgggccgctcccgccgagggaacggccctcccaaggctctgcgccccaattctcgctcgtttgccaagaggtagccgtgtcggggagctagagttctccggggactctctcctgcccctcgtggccctctgtggaaccctcgttttaggatctgcacgccgtttccagtcgcgcgcgcggcacggagaccgcccgctgtgccccgcgctgcgctctctccgcccctctcccgcgcaggcctccctgtgccagccggctgtcgacccaggttaggaagcccgaggtcggggcgttaccccaagggccctcccgcttcccctccgagggcagagaggcgtccgcgcccggacgcactgcgggaacacctggagcgccggcggagctcggctgtccccgcgggagggagcccgacgcgcatccttgggacccggacccggcgcccgcgcctcgggacggatttctgcctcggctgcaggcgcagcgcgcagacctgagcctgccccgcggaaccggggctcgagtcccggcccgagcgcggcgtcggggccagcggagaggggcggaagccgcaagggaccctcggcgcctcggcctggccgcgatgaagtccccgcccctcctcagcccgtgtctctcctggaagagaatggcgggcatctttttcctgccatttatctcatcaggttttgctcctcggtttaagcaggaagagaacttcatgcttggaagagcgcatccgtcccagcctaggtttaattggtctcatctgacccctctggagctgaagaatcgatctgtgggacttggaactgaaagcacaggtcggggtaagccccacttcacactggagggccacaagttcctgatcttcgggggctccatccactatttccgggtgcccagggagtactggagggaccgcctgctgaagctgaaggcctgtggcttcaatactgtcaccacctatgttccgtggaacctgcatgagccagaaagaggcaaatttgacttctctgggaacctggacctggaggccttcgtcctgatggccgcagagatcgggctgtgggtgattctgcgtccaggccgctacatctgcagtgagatggacctcgggggcttgcccagctggctcctgcaagacccccggttactgttgaggacaaccaacaagagcttcattgaagcagttgagaagtattttgaccacctgattcccagagtgattcctctccagtaccgccaggcaggccctgtcatcgcggtgcaagtggagaatgagtatggctcattcaataaggataaaacatacatgccgtatctccacaaggccctgctgagaagagggattgtggagcttctcttgacctctgatggtgagaaacatgtgctgagtggccacaccaaaggagtgttggccgccatcaatttgcaaaaacttcaccaggatactttcaatcagcttcataaagtccagggagccagtatagatgcaggactgctctcagatgcctcacaagcagcaacttcttcctccttatagttcttatctgtgattcttccataattttgtccttctaagcttctgatgcactgaattatgtaaagtgcattcccttcaccagcttgtgcaccctattctgtaactgataataaatggttggtattgca

SEQ ID NO: 8459 - DNA, 2583 bp, Homo sapiens
  ENST00000431683
atgaagtccccgcccctcctcagcccgtgtctctcctggaagagaatggcgggcatctttttcctgccatttatctcatcaggttttgctcctcggtttaagcaggaagagaacttcatgcttggaagagcgcatccgtcccagcctaggtttaattggtctcatctgacccctctggagctgaagaatcgatctgtgggacttggaactgaaagcacaggtcggggtaagccccacttcacactggagggccacaagttcctgatcttcgggggctccatccactatttccgggtgcccagggagtactggagggaccgcctgctgaagctgaaggcctgtggcttcaatactgtcaccacctatgttccgtggaacctgcatgagccagaaagaggcaaatttgacttctctgggaacctggacctggaggccttcgtcctgatggccgcagagatcgggctgtgggtgattctgcgtccaggccgctacatctgcagtgagatggacctcgggggcttgcccagctggctcctgcaagacccccggttactgttgaggacaaccaacaagagcttcattgaagcagttgagaagtattttgaccacctgattcccagagtgattcctctccagtaccgccaggcaggccctgtcatcgcggtgcaagtggagaatgagtatggctcattcaataaggataaaacatacatgccgtatctccacaaggccctgctgagaagagggattgtggagcttctcttgacctctgatggtgagaaacatgtgctgagtggccacaccaaaggagtgttggccgccatcaatttgcaaaaacttcaccaggatactttcaatcagcttcataaagtccagagagataagccccttctgattatggaatactgggtcggctggttcgacagatggggagataagcaccatgttaaagatgcaaaggaggttgaacatgctgtgtctgaattcatcaaatatgagatctccttcaatgtatatatgttccatggtggaaccaactttggtttcatgaacggggccacatatttcgggaagcactcgggcattgtcaccagctatgactatgatgcagtgctcacggaggctggagattacacagaaaaatatctgaagcttcaaaaactctttcaatctgtctcagcaactcccctgccccgagtacccaaacttcctcccaaggctgtgtatccccccgtgagaccgtcgctgtacctcccgctgtgggacgccctatcctacttaaatgagccagtcaggtcgcgtcagcccgtcaacatggagaaccttcccataaacaatgggagcggccagtcctacgggcttgtcctgtatgagaagtccatctgctccggaggccgcctccgtgcccacgctcatgacgtggcacaggtgtttttggatgagacaatgatagggattctgaatgagaataataaggacctgcacattcctgaactcagggactgccgatacctgaggatcctggtggagaatcaaggacgagtcaatttttcatggcaaatacagaatgagcagaaaggaataactggatctgtcagcatcaataactcttccctggagggctttaccatctattccctggagatgaaaatgagcttctttgagaggctccgctctgccacctggaagcctgtcccagacagccaccagggcccggccttctactgtgggaccttgaaggctggcccttctcccaaggacaccttcctgagcctgctgaactggaattatggatttgtgttcatcaatggacgtaaccttgggcgatattggaatattgggcctcagaaaacactgtaccttcctggagtttggcttcatccagaagacaatgaggtcatcttgtttgagaagatgatgagtggctcagatatcaaatctacagacaagcccacgctgtaaaactgtgtctgaacatttttttttttttttgagatggagtctcactttgtcgcccaggctggagtgcagtggcacaatctctgctcactgcaagctcagcctctcgggttcacgccattctcctgcctcagcctccccagcagctgggactacaggtgcacgccaccacgcctggctaattttttgtatttttagtagagatggggtttcaccaagttagccaggatggtcccaatctcctgaccttgtgatctgctctcctcagcctcccaaagtactgggattacaggcgtgagccaccactcccggccgtgaacatattttttgggttgctggagttcatctataagtcatttttgaggaataagatttatgttaagactatcaaacacagtgttgcctacaatagcaaaaatgtgaaaataacaacaacaacaaaacagcagaggaattgttatgtattttgtagtctatctatatgatgcctatttttaggctttaaaaagtcttcaaaatctttaatgactgatttatctagttaaatgcttaatccttagcaggctcttattctttaattaaacgtgcctttgagtagatgtgaataaaataaaaacaagtttc

SEQ ID NO: 8460 - DNA, 430 bp, Homo sapiens
  ENST00000532985
agggagccaagatggcgccaccgcactccagcctgggcgccagagtgagactccgtctcgaaaaaaaacaaaaacccagaaagactgaatatttggatggaagttttaccagaagcacaaatgccgttcacaggcacatgtatgcaacgaggaaagctaatttacaggcatcccattgaactgtgggaaatgctaggaaacttttaagaagcaaggaattataaggtaccgccaggcaggccctgtcatcgcggtgcaagtggagaatgagtatggctcattcaataaggataaaacatacatgccgtatctccacaaggtaagagggccttggtttggccccatgtttacatgcctccttcctcctctgtgcgtttctgattcctggatgcatgagtgatcgggctggacactgtgcattctgagaatg

SEQ ID NO: 8461 - DNA, 3293 bp, Homo sapiens
  ENST00000486034
cgccaccgcactccagcctgggcgccagagtgagactccgtctcgaaaaaaaacaaaaacccagaaagactgaatatttggatggaagttttaccagaagcacaaatgccgttcacaggcacatgtatgcaacgaggaaagctaatttacaggcatcccattgaactgtgggaaatgctaggaaacttttaagaagcaaggaattataaggtaccgccaggcaggccctgtcatcgcggtgcaagtggagaatgagtatggctcattcaataaggataaaacatacatgccgtatctccacaaggccctgctgagaagagggattgtggagcttctcttgacctctgatggtgagaaacatgtgctgagtggccacaccaaaggagtgttggccgccatcaatttgcaaaaacttcaccaggatactttcaatcagcttcataaagtccagagagataagccccttctgattatggaatactgggtcggctggttcgacagatggggagataagcaccatgttaaagatgcaaaggaggttgaacatgctgtgtctgaattcatcaaatatgagatctccttcaatgtatatatgttccatggtggaaccaactttggtttcatgaacggggccacatatttcgggaagcactcgggcattgtcaccagctatggcaagtgtcgctggtgtagtagcctctccagcatgggcggtgctggggctttacagaggaggctccggaagcctgttctggcaccactgggttcttgacctataatctatgctgagtactgaagattttcctatctactttccttccttctgtatgttcataatgccccaacaggctgtcattgcagtagacagggctttccgggacttagagctccgcttcacacatctggtatactgccctgttggcttgaacctctgaagagaggcagggtaggaacggtgactgctgtaaaggcacagacctgcacggccgggcgatacagactgagcaaagaaaagagtacccgttgaaggggtgtccactcttttggcttccctgggccacactggaagaagaagaattgtcttgggccacacatgaaatacactaacactaatgatagctgatgagcttaaaaaaaaaacacaaaatgttttaagaaagtttatgaatttgtgttgggctgcattcaaagccatcctgggccgcctgtagcccatgagctgtgggttgaacaagtttgcattagaaagtgaagaagtgggggcaagcccagtgtcatggcttgacactggaagccagtggaaggtgcccaggaagagttgtggggaatgtccttagactggcatcacacacccacgtgggatggaaggtgtcttccttttgtctcactcacggtggccctggccatctcctgccagcggtgctgaaacagggcctcctgcagagactgcatggctggtgactggccctggtgtcttgcagactatgatgcagtgctcacggaggctggagattacacagaaaaatatctgaagcttcaaaaactctttcaatctgtctcaggtactcagcacccatttaacttacgggccagccctcctcatgtggagtctctgttctgtggaaaagtgaggaaggcgtgggtctcccttgtgggcagcagttacaccaagctcctgagaacaagggcaaccttaacttcgaaccctggggttaaaatctgtgtgattttttaaaatcagggtttctaagcattttataagcctcagtttcttcactgaagcataaagatagtaaccttggtctcctgtgatgactgcgaagattgagttactctttgtaaagctcttataccatggatgacatagtaacccccaatatgaaaggaaaagccatgctggataggcatggggggcttagagaaggcagtggtcatctcaggcactttttgccctgtgccccatctccattgcagcaactcccctgccccgagtacccaaacttcctcccaaggctgtgtatccccccgtgagaccgtcgctgtacctcccgctgtgggacgccctatcctacttaaatgagccagtcaggtcgcgtcagcccgtcaacatggagaaccttcccataaacaatgggagcggccagtcctacgggcttgtcctgtatgagaagtccatctgctccggaggccgcctccgtgcccacgctcatgacgtggcacaggtgtttttggatgagacaatgatagggattctgaatgagaataataaggacctgcacattcctgaactcagggaataactggatctgtcagcatcaataactcttccctggagggctttaccatctattccctggagatgaaaatgagcttctttgagaggctccgctctgccacctggaagcctgtcccagacagccaccagggcccggccttctactgtgggaccttgaaggctggcccttctcccaaggacaccttcctgagcctgctgaactggaattatggatttgtgttcatcaatggacgtaaccttgggcgatattggaatattgggcctcagaaaacactgtaccttcctggagtttggcttcatccagaagacaatgaggtcatcttgtttgagaagatgatgagtggctcagatatcaaatctacagacaagcccacgctgtaaaactgtgtctgaacatttttttttttttttgagatggagtctcactttgtcgcccaggctggagtgcagtggcacaatctctgctcactgcaagctcagcctctcgggttcacgccattctcctgcctcagcctccccagcagctgggactacaggtgcacgccaccacgcctggctaattttttgtatttttagtagagatggggtttcaccaagttagccaggatggtcccaatctcctgaccttgtgatctgctctcctcagcctcccaaagtactgggattacaggcgtgagccaccactcccggccgtgaacatattttttgggttgctggagttcatctataagtcatttttgaggaataagatttatgttaagactatcaaacacagtgttgcctacaatagcaaaaatgtgaaaataacaacaacaacaaaacagcagaggaattgttatgtattttgtagtctatctatatgatgcctatttttaggctttaaaaagtcttcaaaatctttaatgactgatttatctagttaaatgcttaatccttagcaggctcttattctttaattaaacgtgcctttgagtagatgtgaataaaataaaaacaa

SEQ ID NO: 8462 - DNA, 2577 bp, Homo sapiens
  ENST00000498012
gccagagtgagactccgtctcgaaaaaaaacaaaaacccagaaagactgaatatttggatggaagttttaccagaagcacaaatgccgttcacaggcacatgtatgcaacgaggaaagctaatttacaggcatcccattgaactgtgggaaatgctaggaaacttttaagaagcaaggaattataaggtaccgccaggcaggccctgtcatcgcggtgcaagtggagaatgagtatggctcattcaataaggataaaacatacatgccgtatctccacaaggccctgctgagaagagggattgtggagcttctcttgacctctgatggtgagaaacatgtgctgagtggccacaccaaaggaggtacacatttagagttagttcacaggagaacagggctctcagccagcccgtgtaaatcttgaacacactgcagagaaaaccaagtgcatctcgatacctccctttcccgtgtccactgggatggatcctggagttcgatgttacaataaatgaggactcaaggttaaggctcagggccactcacagctccctatcttggccttgctcctgccgtctttaaacacagcagcactggagctcctctgttctcaggacgcctttccatctcccatagtttttctgtggcaagaaatctgcattggtgctgcgcctggcttgggatcagggccatctccactaacttgggaaaccacagggagaaccagaagatgggtgttgtgtcaggaaccccgcctagatccggttccattcctgggatcctaccgcccaaggctctgtgtggacacttaggagatcctagagaattaagtggcaggaagattctggacggactcatcagatggcaatagtgagggacacgcccgggagtgagcaggggagcggggcgagctgctgccggcggctgccgttctgcctccttagtagtggctcttccaaggaagcctggcacactggaacacgtgctgagcttggggccaggaagcctgtgtcccgtttccagtctaatcatgtcagggagccttggcctggctcacttctctgcacagagtgtggttaatttcaacagtgggtgtcctcgcaagtgtcagggatgtggcgatggccgtggcagccctttggatgtggcagagtggggtccagacagcatctcgccatcctcactgctgagcatgggttcctcctgcgtgcgtccgggccgggggcgcattccttcccttccctgacagcacttgtctcatgcctcagctgggtctctctcttctttatgcagtgttggccgccatcaatttgcaaaaacttcaccaggatactttcaatcagcttcataaagtccagccagtcaggtcgcgtcagcccgtcaacatggagaaccttcccataaacaatgggagcggccagtcctacgggcttgtcctgtatgagaagtccatctgctccggaggccgcctccgtgcccacgctcatgacgtggcacaggtgtttttggatgagacaatgatagggattctgaatgagaataataaggacctgcacattcctgaactcagggaataactggatctgtcagcatcaataactcttccctggagggctttaccatctattccctggagatgaaaatgagcttctttgagaggctccgctctgccacctggaagcctgtcccagacagccaccagggcccggccttctactgtgggaccttgaaggctggcccttctcccaaggacaccttcctgagcctgctgaactggaattatggatttgtgttcatcaatggacgtaaccttgggcgatattggaatattgggcctcagaaaacactgtaccttcctggagtttggcttcatccagaagacaatgaggtcatcttgtttgagaagatgatgagtggctcagatatcaaatctacagacaagcccacgctgtaaaactgtgtctgaacatttttttttttttttgagatggagtctcactttgtcgcccaggctggagtgcagtggcacaatctctgctcactgcaagctcagcctctcgggttcacgccattctcctgcctcagcctccccagcagctgggactacaggtgcacgccaccacgcctggctaattttttgtatttttagtagagatggggtttcaccaagttagccaggatggtcccaatctcctgaccttgtgatctgctctcctcagcctcccaaagtactgggattacaggcgtgagccaccactcccggccgtgaacatattttttgggttgctggagttcatctataagtcatttttgaggaataagatttatgttaagactatcaaacacagtgttgcctacaatagcaaaaatgtgaaaataacaacaacaacaaaacagcagaggaattgttatgtattttgtagtctatctatatgatgcctatttttaggctttaaaaagtcttcaaaatctttaatgactgatttatctagttaaatgcttaatccttagcaggctcttattctttaattaaacgtgcctttgagtagatgtgaataaaataaaaacaagtttca

SEQ ID NO: 8463 - DNA, 1279 bp, Homo sapiens
  ENST00000455971
tgttaaagatgcaaagggttgaacatgctgtgtctgaattcatcaaatatgagatctccttcaatgtatatatgttccatggtggaaccaactttggtttcatgaacggggccacatatttcgggaagcactcgggcattgtcaccagctatgactatgatgcagtgctcacggaggctggagattacacagaaaaatatctgaagcttcaaaaactctttcaatctgtctcagcaactcccctgccccgagtacccaaacttcctcccaaggctgtgtatccccccgtgagaccgtcgctgtacctcccgctgtgggacgccctatcctacttaaatgagccagtcaggtcgcgtcagcccgtcaacatggagaaccttcccataaacaatgggagcggccagtcctacgggcttgtcctgtatgagaagtccatctgctccggaggccgcctccgtgcccacgctcatgacgtggcacaggtgtttttggatgagacaatgatagggattctgaatgagaataataaggacctgcacattcctgaactcagggaataactggatctgtcagcatcaataactcttccctggagggctttaccatctattccctggagatgaaaatgagcttctttgagaggctccgctctgccacctggaagcctgtcccagacagccaccagggcccggccttctactgtgggaccttgaaggctggcccttctcccaaggacaccttcctgagcctgctgaactggaattatggatttgtgttcatcaatggacgtaaccttgggcgatattggaatattgggcctcagaaaacactgtaccttcctggagtttggcttcatccagaagacaatgaggtcatcttgtttgagaagatgatgagtggctcagatatcaaatctacagacaagcccacgctgtaaaactgtgtctgaacatttttttttttttttgagatggagtctcactttgtcgcccaggctggagtgcagtggcacaatctctgctcactgcaagctcagcctctcgggttcacgccattctcctgcctcagcctccccagcagctgggactacaggtgcacgccaccacgcctggctaattttttgtatttttagtagagatggggtttcaccaagttagccaggatggtcccaatctcctgaccttgtgatctgctctcctcagcctcccaaagtactgggattacaggcgtgagccaccactcccggccgtgaacatattttttgggttgctggagttca

SEQ ID NO: 8464 - DNA, 1965 bp, Homo sapiens
  ENST00000410100
ttggtttcatgaacggggccacatatttcgggaagcactcgggcattgtcaccagctatggcaagtgtcgctggtgtagtagcctctccagcatgggcggtgctggggctttacagaggaggctccggaagcctgttctggcaccactgggttcttgacctataatctatgctgagtactgaagattttcctatctactttccttccttctgtatgttcataatgccccaacaggctgtcattgcagtagacagggctttccgggacttagagctccgcttcacacatctggtatactgccctgttggcttgaacctctgaagagaggcagggtaggaacggtgactgctgtaaaggcacagacctgcacggccgggcgatacagactgagcaaagaaaagagtacccgttgaaggggtgtccactcttttggcttccctgggccacactggaagaagaagaattgtcttgggccacacatgaaatacactaacactaatgatagctgatgagcttaaaaaaaaaacacaaaatgttttaagaaagtttatgaatttgtgttgggctgcattcaaagccatcctgggccgcctgtagcccatgagctgtgggttgaacaagtttgcattagaaagtgaagaagtgggggcaagcccagtgtcatggcttgacactggaagccagtggaaggtgcccaggaagagttgtggggaatgtccttagactggcatcacacacccacgtgggatggaaggtgtcttccttttgtctcactcacggtggccctggccatctcctgccagcggtgctgaaacagggcctcctgcagagactgcatggctggtgactggccctggtgtcttgcagactatgatgcagtgctcacggaggctggagattacacagaaaaatatctgaagcttcaaaaactctttcaatctgtctcaggtactcagcacccatttaacttacgggccagccctcctcatgtggagtctctgttctgtggaaaagtgaggaaggcgtgggtctcccttgtgggcagcagttacaccaagctcctgagaacaagggcaaccttaacttcgaaccctggggttaaaatctgtgtgattttttaaaatcagggtttctaagcattttataagcctcagtttcttcactgaagcataaagatagtaaccttggtctcctgtgatgactgcgaagattgagttactctttgtaaagctcttataccatggatgacatagtaacccccaatatgaaaggaaaagccatgctggataggcatggggggcttagagaaggcagtggtcatctcaggcactttttgccctgtgccccatctccattgcagcaactcccctgccccgagtacccaaacttcctcccaaggctgtgtatccccccgtgagaccgtcgctgtacctcccgctgtgggacgccctatcctacttaaatgagccagtcaggtcgcgtcagcccgtcaacatggagaaccttcccataaacaatgggagcggccagtcctacgggcttgtcctgtatgagaagtccatctgctccggaggccgcctccgtgcccacgctcatgacgtggcacaggtgtttttggatgagacaatgatagggattctgaatgagaataataaggacctgcacattcctgaactcagggactgccgatacctgaggatcctggtggagaatcaaggacgagtcaatttttcatggcaaatacagaatgagcagaaaggaataactggatctgtcagcatcaataactcttccctggagggctttaccatctattccctggagatgaaaatgagcttctttgagaggctccgctctgccacctggaagcctgtcccagacagccaccagggcccggccttctactgtgggaccttgaaggctggcccttctcccaaggacaccttcctgagcctgctggtaggt

SEQ ID NO: 8465 - DNA, 3862 bp, Homo sapiens
  ENST00000467068
ttggtttcatgaacggggccacatatttcgggaagcactcgggcattgtcaccagctatggcaagtgtcgctggtgtagtagcctctccagcatgggcggtgctggggctttacagaggaggctccggaagcctgttctggcaccactgggttcttgacctataatctatgctgagtactgaagattttcctatctactttccttccttctgtatgttcataatgccccaacaggctgtcattgcagtagacagggctttccgggacttagagctccgcttcacacatctggtatactgccctgttggcttgaacctctgaagagaggcagggtaggaacggtgactgctgtaaaggcacagacctgcacggccgggcgatacagactgagcaaagaaaagagtacccgttgaaggggtgtccactcttttggcttccctgggccacactggaagaagaagaattgtcttgggccacacatgaaatacactaacactaatgatagctgatgagcttaaaaaaaaaacacaaaatgttttaagaaagtttatgaatttgtgttgggctgcattcaaagccatcctgggccgcctgtagcccatgagctgtgggttgaacaagtttgcattagaaagtgaagaagtgggggcaagcccagtgtcatggcttgacactggaagccagtggaaggtgcccaggaagagttgtggggaatgtccttagactggcatcacacacccacgtgggatggaaggtgtcttccttttgtctcactcacggtggccctggccatctcctgccagcggtgctgaaacagggcctcctgcagagactgcatggctggtgactggccctggtgtcttgcagactatgatgcagtgctcacggaggctggagattacacagaaaaatatctgaagcttcaaaaactctttcaatctgtctcaggtactcagcacccatttaacttacgggccagccctcctcatgtggagtctctgttctgtggaaaagtgaggaaggcgtgggtctcccttgtgggcagcagttacaccaagctcctgagaacaagggcaaccttaacttcgaaccctggggttaaaatctgtgtgattttttaaaatcagggtttctaagcattttataagcctcagtttcttcactgaagcataaagatagtaaccttggtctcctgtgatgactgcgaagattgagttactctttgtaaagctcttataccatggatgacatagtaacccccaatatgaaaggaaaagccatgctggataggcatggggggcttagagaaggcagtggtcatctcaggcactttttgccctgtgccccatctccattgcagcaactcccctgccccgagtacccaaacttcctcccaaggctgtgtatccccccgtgagaccgtcgctgtacctcccgctgtgggacgccctatcctacttaaatgaggtgcgtgctgcctggccacaggaggcggagtggccattggagggatgggggagggattccttcaggaaactttttattaggaagtgggaaaacaaatcctctgcatttcattcaaatttagaactgtgggacaagagccaccagctccttccgggtggactgtgaaggggtttgaccttggagtcagtgtgcaggggaggggcagcaggacgtcggaggatcccgggttcccgcttagatgaacctgtctggagatgctcttgtttggactgtgtggtccttacggaatccacgtaggaaaagctgctgagctggaatcgggagactagcttctgcccgtgcttcaccagcagctgggcctgaacttcctgggtcactgctcccccttttccatcagccttcctgtcctattttgaagaaaggtgaaagctgtttggaactgaaactgtagcccttggattcacattggttttacctctgctatcactattttagagaaaaggtagtgactggtacactaaagaaactacatttatttaatgtaactaaatttaatttaatgaaataaacatttgcttggtgcctcattcattgctagacttcaactattttagaatacaatttatttactctttttttttcttgagacagggtcttgcttggtggctgtggctggaatgcggtggcacaatcatggctcactgcagccttgaactcctgggctgaagcaatcctccggcctcagcctcttgagtagctgggattacaggagggcaccaccacgcccagctacatttttaagttttttgtagatgtgggtctcactatgttgcccaggctgctctcaaactcctggcctcaagtgatgcacctgctgcggcctcccaaagtgctgggattacaggcgtgagcccctgcgccccatccatttcctctgttaatcagttcttaggattataacgattgctccctcatcaccatgccctgcatttccctgagtttccttcctgggcagtggagacgtaagcacagagcagtgtcacatggcatctgtttcatcatttcccatttgaagaacccttggggaccattaggcaggaccaaatgacagggtcttaggaaggaggatcctgactgctcagcccttggacttctgctcttgccatttctcctcatagccagtcaggtcgcgtcagcccgtcaacatggagaaccttcccataaacaatgggagcggccagtcctacgggcttgtcctgtatgagaagtccatctgctccggaggccgcctccgtgcccacgctcatgacgtggcacaggtgtttttggatgagacaatgatagggattctgaatgagaataataaggacctgcacattcctgaactcagggaataactggatctgtcagcatcaataactcttccctggagggctttaccatctattccctggagatgaaaatgagcttctttgagaggctccgctctgccacctggaagcctgtcccagacagccaccagggcccggccttctactgtgggaccttgaaggctggcccttctcccaaggacaccttcctgagcctgctgaactggaattatggatttgtgttcatcaatggacgtaaccttgggcgatattggaatattgggcctcagaaaacactgtaccttcctggagtttggcttcatccagaagacaatgaggtcatcttgtttgagaagatgatgagtggctcagatatcaaatctacagacaagcccacgctgtaaaactgtgtctgaacatttttttttttttttgagatggagtctcactttgtcgcccaggctggagtgcagtggcacaatctctgctcactgcaagctcagcctctcgggttcacgccattctcctgcctcagcctccccagcagctgggactacaggtgcacgccaccacgcctggctaattttttgtatttttagtagagatggggtttcaccaagttagccaggatggtcccaatctcctgaccttgtgatctgctctcctcagcctcccaaagtactgggattacaggcgtgagccaccactcccggccgtgaacatattttttgggttgctggagttcatctataagtcatttttgaggaataagatttatgttaagactatcaaacacagtgttgcctacaatagcaaaaatgtgaaaataacaacaacaacaaaacagcagaggaattgttatgtattttgtagtctatctatatgatgcctatttttaggctttaaaaagtcttcaaaatctttaatgactgatttatctagttaaatgcttaatccttagcaggctcttattctttaattaaacgtgcctttgagtagatgtgaataaaataaaaacaagtttc

SEQ ID NO: 8466 - DNA, 3900 bp, Homo sapiens
  ENST00000321612
attggccaagggcttcctggccccaacccacctcccgcctccagggcgccgcttaaagtgtgcggagcaggtgccttgggtggagccacaactttgcgcgagtgtcttggttgagcgcagcgcccattcattgcccgcgagcgtccatccatctgtccggccgactgtccagcgaaaggggctccaggccgggcgcagccgccacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatctgcatttattagtattctaataaaagcatcttgatcggaagaa

SEQ ID NO: 8467 - DNA, 878 bp, Homo sapiens
  ENST00000638274
actccctgacctgcgttacatcttcccactgggaccggccttattccagagaggtggcagcattcccactcacggagtctcgctctgttgcccaggctggagtgcagtggcatgatcctgggttcacgccattctcctacctcagcctcccgctgggactacaggcgcctgccaccatgcccggcccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatctgcatttattagtattctaataaaagcatcttgatcggaa

SEQ ID NO: 8468 - DNA, 1559 bp, Homo sapiens
  ENST00000639639
atagaggacatttctgtgaacaccatggatgtggctctgcctgcttttcctctgaggggagaaggcagcaccggccagccatggccttcacactggagggtgcttccaagctcttgacttttgcttttggcccttgcctttgtggtaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatctgcatttattagtattctaataaaagcatcttgatcggaa

SEQ ID NO: 8469 - DNA, 1852 bp, Homo sapiens
  ENST00000640505
gagagccgaacctgagactgccaggaatggtgtcacattaaaagtgcctcattcttttggggctgatcaggcccttgactcgatatttgcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatctgcatttattagtattctaataaaagcatcttgatcggaa

SEQ ID NO: 8470 - DNA, 2046 bp, Homo sapiens
  ENST00000638233
atcacatctgccctgtgtgatgggtactgttactatccccattttacacatctctcaggcacataggcacagggagatgaagttacttgtgatgtgagtggtttcctgaagcacggcatattcattttcttgtcctcaaaatgaaaaaacctcaaataggctaggacttgtttttcagaagccaggaaaacagaagagcagtctttgcctttcttcttggaagagagcggagatagctgcagctgactcagtgcgggtgacgaggaacggggtgactcaggtcttcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatctgcatttattagtattctaataaaagcatcttgatcgg

SEQ ID NO: 8471 - DNA, 3298 bp, Homo sapiens
  ENST00000639364
gtcttttgtggttccctgaaaatcgagctctggggtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatctgcatttattagtattctaataaaa

SEQ ID NO: 8472 - DNA, 1796 bp, Homo sapiens
  ENST00000638661
ataaatattgaatgagtaaatgaaagccagaagacctaaccgtgatccctttcttcttgtctttgcaagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatctgca

SEQ ID NO: 8473 - DNA, 2674 bp, Homo sapiens
  ENST00000639461
ctcgctttgtctcccaggctgcagtgcagtggtgccatctcggctcactgcaaccaccaccttccaggttcaagcaattctctcactcagtctcccgagtagctggaactacaggcacccgcccctacacctggctaatttttgtaatttttttttcgtagagacagggtttcaccatgtcggccaggctggttttgaactcctgacctcaagtgatttgcctgcctcagcctcccaacgtgctgggattacaggtgtgagccaatgagcccagctccacctctttcatgtttattcattctataagaagcagagcagttcgtagactgtcttcaggggctattaattactggagctattcttcacaggcttgagaagttatgcttgctctgagtctctataagtggattcatttttgctgagagtgaggaaagtgggttaagaagaaggagtacatcattatctcatgagtagatactttcctggaaggaaattcatcagttggtggaccgtggaatttgggaagccccggaggaatattggtctatttattaaaacgctgacttaatggtttattcctgatgatggttgtgtggtcagtagctcattctggggagctactggcagcctggacctagagaagaagcctgtttatgaactacaggtcgaatatccctaatctgaaaatctaaaactttttctaaaaatttatatttatttttttgagacagggtcttgcccctattacccaggctggagtgcagttgtgtgatcgcggctcactgcagcctcgacttcccaggctcaggtgattctatttttagtagggctagggtttggccatgttgccctggctggtctggaactcctgatctaaaacgatctgcccacctcagcctcccaaagtgctgggattaccagcatgagtcactgtgcctggcctgaaaatccaaaacttttgggtgcccacatgaggctcaaataaagatctgtaatttcaaataagggatatgtcattggtagaacaaagtgaactgggtcgcacagactttggcctcattaactccttgttacttacggtatactgtttgacgtcgcgtatttctaattctttgtttgcagcctgaaaccaaaacatcaaaaggtccttcaaagaaacataaaattctgtatgtgtcttatggatatatgtttaatatatccatacctatatatacgcaaaagtaattatttgatgttgagggtaaagttgctgaaaagtgtcaatggctctagaaatattttgtataaaaggatcaggactatacaacacatttaactgttgcaagtagattttatgtccgcagaatagaaataatctcatccccagacacctccggtcatatgttcagtaatgccccccacctgccattagccataatcaggttcacaggtgtgtagtgagctgaagataagacacatcggcacagtgtgctaaacatttttatttgtaataagactaaatgaaacctttattgccaataataaacttacccggtgcccatggcttcttggtcctcgctgatacacataaaaagctgatgcacttatttattaaattacttattcatttgtttgggtaaaacaataagctgatgctaatcttgggctgaaacaactttcctgaacaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatc

SEQ ID NO: 8474 - DNA, 3279 bp, Homo sapiens
  ENST00000639954
gatttcaatgaggttcccacaaggctttgtagtcgcaaaacacagaggtgactcttttaactcagaggcactttcctctgccttgcgttttaattttagagcattgatgaattgatcgagaagacggtccctgccaacatccgtttgaaaagacccttgaaaatggaagaccctgtttgatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaa

SEQ ID NO: 8475 - DNA, 2009 bp, Homo sapiens
  ENST00000639318
ttcagcatgaaagtggttagtgagaaatataataggaaacaagattgaccgtaaaccaaattgttacagctggctgacacacacgtcgtagttccttttgttcttcactgtattttggtatagttttgaaatttttcataataacaaaaggctattttcaatgcgtggtcctgagcaaggatatagaaagctccatctttgggtaggagtggttgagctgtagtgcacaaactggatgctgttgctttgattgttttgattgttcaagaccttttgactccagcagagctccttgatgagcttctctcagcgtctggacagtgaccatgtgtcacgtgctggtgaacccctggccagggcccaataaatattgaatgagtaaatgaaagccagaagacctaaccgtgatccctttcttcttgtctttgcaagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcaca

SEQ ID NO: 8476 - DNA, 1614 bp, Homo sapiens
  ENST00000638694
aatggagaatgactggggtgagggaagggacccaggccggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtg

SEQ ID NO: 8477 - DNA, 762 bp, Homo sapiens
  ENST00000477960
ctaatcttgggctgaaacaactttcctgaacaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaaggtgcgtaggccctggaacattgcttgaaatgttccttaaactagaaaatgatgtctggacagtgtaccagcaactcccgaactctcaactgaggatgatactcttccctagaataagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatat

SEQ ID NO: 8478 - DNA, 2727 bp, Homo sapiens
  ENST00000639443
atttttagtagagacggagtttcaccgtgttagccaggatggtcttgatctcctgacctcgtgacccgcccacctccgcctcccaaagtcctgggattacaggcttgagccactgcgcccggcccgttttgttttctttttgtagaaagaataaaaatattgttttgatcaggttttggaacgtttgaaaaacagagaaaaatgggactcacatacaactgttaagattttgtgtgtattccttgcaaacgtagtttacagagggtgtgcagagtccctagatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtag

SEQ ID NO: 8479 - DNA, 2828 bp, Homo sapiens
  ENST00000640592
agagttttccttttcttttaaaaagaaccctaattaggcgatttcaatgaggttcccacaaggctttgtagtcgcaaaacacagaggtgactcttttaactcagaggcactttcctctgccttgcgttttaattttagagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtacttgtcttctccttagcagatgggagaggccgggatggggagtgctggtggggatcagggacttgatggattatgtaaatgtcttctcttgcattctaatgaaaagtctgcagttcttcctttgaccagagtctactctacccctcccatcaccaacagggagaaatccccgttttctaattccagcttgtgtaaaaaactgaatgaattattcatggtggtagtaagagtactccttgcagaacctgcctgcctctttctgcccaatcttccctctccttctcgccttccccacttaataatcaaaatggcagtcacacttacacatcttcgtgtcaggaattgtaacacaaatgtcagctttgcaaatatccatgactgtgccagccccatcatgctgaattcctggcatcatgcagcttggtttccaccaacccccactctcaacctcccaacctccaggaagaagttgcttagcaaccgtatctgcttcccaccagcggactggcagctgcatcttaagcgggaaggaaaccagtggaatagcaatgtgattttgatggtggtgttattaggcatggagactgtgaactctgtgcagttgccttctaaaggaagctgaaaatccacaatgctgcacctctcttcgatccacctctacccttccattgctccacaaagcttttttccaacaagtgttccaggccagtagttgaaattattaagtccctccattatagtaatataggacatgacttccctggccacccccatgttctcaaacatgcctgctctgatatgctggccaggaaaacaaacagggatgtgacttttatatatgcttgccttctgtaaaaggaaagaataaagaagacttttatttacagaaa

SEQ ID NO: 8480 - DNA, 386 bp, Homo sapiens
  ENST00000460457
tctttgcaagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggaagaagttgcttagcaaccgtatctgcttcccaccagcggactggcagctgcatcttaagcgggaaggaaaccagtggaatagcaatgtgattttgatggtggtgttattaggcatggagactgtgaactctgtgcagttgccttctaaaggaagctgaaaatccacaatgct

SEQ ID NO: 8481 - DNA, 420 bp, Homo sapiens
  ENST00000640208
ttctctcagcgtctggacagtgaccatgtgtcacgtgctggtgaacccctggccagggcccaataaatattgaatgagtaaatgaaagccagaagacctaaccgtgatccctttcttcttgtctttgcaagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtacttgtcttctccttagcagatgggagaggccgggatggggagtgctggtggggatcagggacttgatggattatgtaaatgtct

SEQ ID NO: 8482 - DNA, 652 bp, Homo sapiens
  ENST00000463305
tggagtcctcactgagctgaagttaccctgtgaaatggacttcagtggaaaagatgtcagtggagtgttgttccagtacccagacacggaggggaaggtggaagactttacggaactcgtggagagagctcatcagagtgggagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatca

SEQ ID NO: 8483 - DNA, 620 bp, Homo sapiens
  ENST00000640703
aacaagagtctagtagaatttatctctttattattctgtgacatgtcaatggctgaggagcaggtttctatatgagagtttgggggatctcctatcttgtgtaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagtaagtaaaataaaaacatgcgttcctcatcataactattggaggtggtagcaaaagtagcttatcccctgagtgtgagggagaaggggcccaagtgtgacactggtagcttgttgttaaaattattccactgactatcccttgctagtcactgctgacagctggaggtcactgctgtagggctccagccagtattatgcacccaggctagttggaaagattgttaatggtgtttcattgaaagtgcctctaggctggggatggtggctcatgcctgtaatcccagcactttggg

SEQ ID NO: 8484 - DNA, 553 bp, Homo sapiens
  ENST00000639493
acttcctttctagagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcaca

SEQ ID NO: 8485 - DNA, 626 bp, Homo sapiens
  ENST00000638654
aaaatgaatgctgtcttactggaaaagaaacgttaattaattttcccttataaaccgaaagcacgattgttctttgttgtctgtctttccagatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccacttt

SEQ ID NO: 8486 - DNA, 600 bp, Homo sapiens
  ENST00000639840
tgaccccccacctccctcccggacggggtggctgccgggcggagacgttcctcacctcccagacggggtcgcggccaggcagaggtgctcctcacatcccagaccgggcggcggggcagaggcgctccccacatctcagacgatgggcggccgggcagagacgctcctcacttcctagatgggatggcggcccggaagaggcgctcctcacttcctaggtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaata

SEQ ID NO: 8487 - DNA, 401 bp, Homo sapiens
  ENST00000639020
gggctcctcacttccccgtaggggcggcggggcagaggcgcccctcacctcccagacagggcggctggccgggcaggggctgaccccccacctccctcccggacggggtggctgccgggcggagacgttcctcacctcccagacggggtcgcggccaggcagaggtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggaca

SEQ ID NO: 8488 - DNA, 4971 bp, Homo sapiens
  ENST00000335449
aaaggctgccagggccgcaggctgccaagccctgccctgcccaaggcgcatagagcatggcccgaggcgctgagggaggccgtggggacgcgggttggggcctgcgtggcgccctggcggccgtggcgctgctctcggcgctcaacgctgcgggcacggtgttcgcgctgtgccagtggcgcgggctgagctcggcgctgcgggctttggaggcgcagcggggccgggagcagcgcgaggacagtgccctgcgctccttcctggccgagttgagccgcgcgccgcgcggggcgtccgcaccaccccaagacccggccagctcagctcgcaacaagcgcagccacagcggcgagcccgcgccgcatatccgcgccgagagccatgacatgctgatgatgatgacctactccatggtgccgatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatggggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccataccaaatgatgataccttggttggaaaagctgatgagaaagccagtgaacaccattccccacaagcagaatccatgatcacttccattggaaacccagtgcaagtactgaaagtgacagagacatttgggacttggataagagagtctgctaacaagagtgatgaccggatttgggtgacagagcatttttcaggcatcatggttaaggaattcaaggatcagccctcacttctgaatggcagttacacgttcatccaccttccatactatttccatggctgtgggcacgttgtttacaacaactctctctactaccacaaagggggttctaataccctagtgagatttgaatttggccaggaaacatcccaaactctgaagcttgaaaatgccttgtattttgatcgaaaatacctttttgcaaattccaaaacttacttcaatctagctgtagatgaaaagggcctttggattatctatgcgtcaagtgtggacggctcgagcattcttgtagcacaactggatgagaggacattctcagtggtgcaacacgtcaataccacgtaccctaaatccaaggctggcaacgccttcattgcccgaggaatcctctatgtcacagacaccaaagatatgagggtcacatttgcctttgatttgttaggagggaaacagatcaatgcaaactttgatttaagaacttcccagtctgttcttgccatgttagcatacaacatgagagatcagcatttatattcatgggaagatggccatttaatgctttatcctgtgcagtttttgtcaactaccttaaatcagtgatgtgctgcattcggctcccttcagcaaatttcaggggttttctgggaccagttctcccccaacaggaaacttgtttttttaacgtcagccagatatttagaaaataacctcaaaagtgtttatatggtcagtgagccccgcttagtgaaatagcaacagattggaagttgaaatggctgagatttggtgatctccccacagctggctctgcaagttacctctttctccttgggccttagtttccccattggtaatctgaattggctaagatgattggggagattttctgtacctgtaggtaatttggtgattcttggtggctgctcttctcacaacttttatgtatctgcttctgtcgtttagcttttttagccacatgctgaccaaatttacctttgagttgataagtccagtggcttgagtagtgaatccctcagtgctgacttatatcttgttctttgaaaaaatgcattgactctttaagacatctaaagtatcacattatccataatttattgcttttctttgcatctgcacctgccaccacagaataaccattaccctcagctgctgattgggcagctctgagattagcaaaagccagggacagctacatgttcaggtttttttttttttttttttttcaataagctattttttttcttttcttattttaaatagagagagagtcttgctatgtttcccaggctggtcttgaactcctggggctcaagtgatcctcctgccttggcctcccaaaatgctggattacaggcatgtgtgcctggcccaggtttcttaataaaacagaatcatgatcttccaggttccccccagtttctgatcatgttgatttgtagctgtggatcatgaacactgaatcctcagatcactctgacttcttatgcttctcctgtggatccactatcaaagtactaaatgctgtgtaagtagacgttaatctggctggaaccatgggaagcactttgcagtgttcagaagagaggctccatttgtggctattatgtagaactgggccagagccagtccattgcctgtttttttaaataaggttttactgagcacagccacactcatttgtttatgcagtacggcctgacattgcttttgctctgcaacagcagagtcgagtcattgcaacaaagagcatatggccccacagtgcctaaaatattgaccagctacccctttatggaaaaagattgctgactcctgataaagaatataaagtgagcctgattcttgaaaaaatcagaaccagagcctgttttgttttgttctaaactaagaagccgcataggatgtgacttgcgttttgagtagaggggaaggctgataacggcgtaagatgaagtggccctccacaaaggctggttaggggacagttctttctctaacatagttttaaaggatgtgatctggtccccttggatgccaggagagaatccagttgaacttgctcctaaatgctcttaaatatgcatattttctgccaactcacttctttaaacatctttcagcccagcgctgcggccccgggaagggccactgcgaatagagaggaagctggaaaagttcctggggctctgcagccaggaaggggaaccagggcaaatcttatgtaaagatttttcagcaacttgtcccaatttgtgtgtattctgaaactttctctttgggaccaaattcattctcaatggccctgagttcaatatattattaacagcagtattttaaaacttagggttgaactgggcatggtggcacataactgcaatcccagctactttggaggcagggatgggaggatcacttgaggccaggatctcaggaccagcctagagagatcccatctctaaaaaataaaatataagaaaataaaacttaggggatatacagatttaaatattcaaatctccctgctcccctgaaagtccccaggcagctgtcaatgacttgtttgttgtgttctcaatatgatggctatttgaaacttcacctacttttcattagattggttgtaccatgtcaccttagcttttaaaaatactcttttcagattcacgttctctaacaaagagtctcatgttcaagatcaatatgtctaataagtgctggtgtccttttaaagtatttaaatatatatgttgctgttgctgaatacaggagaccaggttaggaatatagtttcataataatagtacatacaatactaattgtatataaggtagcaaccaaaagaggttgttaattagcacatattccttttagaaaaatgtttcagaaacctcagtcttgatatctgagctatctgggctcccttacttgtgagtaagggatcatgctcaccactggagaagcttacaccgggactttttttcttttttcttttttttttgctatgacagagtaatgctaacgtaaggacaactgagtttgatcagtgtttaatcgcagtgggtaatcttatctgattgtctttaaaagtgaaaaggattaagattttattctttcttgtaaacattacttgattttttaaagaagttttgggctcactgctaaaatagagtatacaactgaatgtttttaagtcaagatactgttttaggagtttaccctctcatttataaccaaagttgctctaaaacactttccaaatatctgcacttctgatgtcagaatcaaaccagataattctctaattcttctttaatctaaagtagatagcttcccactggaaagtaaacaaaaccatccctcccaacctcaaagctaggccacactctatttcaaggcattttctttcagctgataaggtgtcctcctgaagccaagtaggtggttctggtctccaagtatcgttaagcacaggtgctatgacagaaaaagttctggggtggaagttttaagatgaggagttctgatcttaggcatcttaacagtcacaaggtgaaaagtcaaatgaaacagtacaattcttgatgagtgaggtgtcatcttccaaccacacagaggacgttttggctatgatcatctgatggcaagtgaaggagaaatgagtgatagggctttgcgttttcatccagatgctgtggccctgtgtttcacagcattaagagccataatttccaacctgcacagatcctgaacaacaaatgaataacgatgaatgtctttttggttgtaatttaacaagtcaaataaaataatcattgctgagcacaatcacatgttgaaa

SEQ ID NO: 8489 - DNA, 2088 bp, Homo sapiens
  ENST00000560215
gtgccagtggcgcgggctgagctcggcgctgcgggctttggaggcgcagcggggccgggagcagcgcgaggacagtgccctgcgctccttcctggccgagttgagccgcgcgccgcgcggggcgtccgcaccaccccaagacccggccagctcagctcgcaacaagcgcagccacagcggcgagcccgcgccgcatatccgcgccgagagccatgacatgctgatgatgatgacctactccatggtgccgatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatgggtatttttggcaactcttctaattaatttccctgttatttatctccatgattgcatttgggtcgactaaaactgtgtgcagcaggggtaaggtgtttcatctctgcacagtttaaggccggtttaactcttacctagaagccattgcgttccgggataccaagggtatacttcttggtcccaccttgacagatgtttatttcaaactggagaagccgtctcctgggaactgactcgcacccttctgctgcagatgggaggtggaaggagcaggagcccacagccctgggaggggcattctgtgggccgtgtgacagctggtgctggtgcatgctctttcgaggctcagctcctgccttgccctctattgcctcctcctgcccagcgaatctgtgtttggttgaaaatcaatgaactgatgttggcccctggtaaggcatttcttggctagaggaatagctcaaactgcttgagtggaaaggcagcatcctggcctccctgtggccggcactcaggtcaaagggtctcctcttcaggggctacaggataactatgaagatatggctggcatctcggaggagcttcctttgccctgttatgagcaggccatcaccactggagaaaaggcccagaagcaccaaggcacgagatgtgcccagggagcagtaagaatcaggggctggtgcagggcctggcaggaggctggggcacaaaggggaagattctgaagggctctgagcaccagtcctggggagccggggtcagggcagatccacctgaagaaagctggcacatgctgtggtgggagctcaaagacagagggtaagaaactactcaggaggctcctacgaaggcctggctctcagccacccgtcaaagccactgctgagggcagagggaggttgttttcagccggagactccactgcaccatcttattttcaacctcttggctctgctacccaaactcacttggactggccctggacgagaagaaatggtagaaaattcttccagacagcaattactcctttggtcacctccactcttattctcattagcaattgaagtaagggccagtggagagggaaaaattgtcgagcacctctgacacttggcagtgcctacctgcttgtgttccagagggcagcttcagagaaaacgggcacacaccgtccaagccagctcaatcctcagaaggccagtaattaccattggaattacacagcagcaatggatcgttcatataggataataattataattatacatgagcatcgctgtagaataatgatgcctattggcttatcctgggaagactccaaaaatgtgattcagtcctgaggcctcggcaatgggcatgatgagggcaggctcaggggcaggagggcaccctgctagagctgggtgtggggcacgtaggaaaggggtggttttcaaaaaggcttgagacagatccctggccttgaggatgtgcttcgcatgcagcctgcaacccagggagtgcagaaaagaaaaagtgcatttgtttatggagcacatatttgtgtggcaggtaccattctagatgctggagattcagaaataagcccccctcctccaccttcacgaggcttacatcctagctgggagagacggataataaataagataaataaatag

SEQ ID NO: 8490 - DNA, 1042 bp, Homo sapiens
  ENST00000558286
gccctgcgctccttcctggccgagttgagccgcgcgccgcgcggggcgtccgcaccaccccaagacccggccagctcagctcgcaacaagcgcagccacagcggcgagcccgcgccgcatatccgcgccgagagccatgacatgctgatgatgatgacctactccatggtgccggaccttctggaccaccaggacctccgggagccggcgggttgccaggacacaacggattggatggacagcctggtcctcagggcccaaaaggagaaaaaggagcaaatggaaaaagaggaaaaatgggtatttttggcaactcttctaattaatttccctgttatttatctccatgattgcatttgggtcgactaaaactgtgtgcagcaggggtaaggtgtttcatctctgcacagtttaaggccggtttaactcttacctagaagccattgcgttccgggataccaagggtatacttcttggtcccaccttgacagatgtttatttcaaactggagaagccgtctcctgggaactgactcgcacccttctgctgcagatgggaggtggaaggagcaggagcccacagccctgggaggggcattctgtgggccgtgtgacagctggtgctggtgcatgctctttcgaggctcagctcctgccttgccctctattgcctcctcctgcccagcgaatctgtgtttggttgaaaatcaatgaactgatgttggcccctggtaaggcatttcttggctagaggaatagctcaaactgcttgagtggaaaggcagcatcctggcctccctgtggccggcactcaggtcaaagggtctcctcttcaggggctacaggataactatgaagatatggctggcatctcggaggagcttcctttgccctgttatgagcaggccatcaccactggagaaaaggcccagaagcaccaaggcacgagatgtgcccagggagcagtaagaatcaggggctggtgcagggcctggcaggaggctggggcacaaaggggaagattctgaagggctctgagcacc

SEQ ID NO: 8491 - DNA, 1059 bp, Homo sapiens
  ENST00000560690
agctcagctcgcaacaagcgcagccacagcggcgagcccgcgccgcatatccgcgccgagagccatgacatgctgatgatgatgacctactccatggtgccggtaggcggggtctctgttccccgtggcgccccggccagatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatgggtatttttggcaactcttctaattaatttccctgttatttatctccatgattgcatttgggtcgactaaaactgtgtgcagcaggggtaaggtgtttcatctctgcacagtttaaggccggtttaactcttacctagaagccattgcgttccgggataccaagggtatacttcttggtcccaccttgacagatgtttatttcaaactggagaagccgtctcctgggaactgactcgcacccttctgctgcagatgggaggtggaaggagcaggagcccacagccctgggaggggcattctgtgggccgtgtgacagctggtgctggtgcatgctctttcgaggctcagctcctgccttgccctctattgcctcctcctgcccagcgaatctgtgtttggttgaaaatcaatgaactgatgttggcccctggtaaggcatttcttggctagaggaatagctcaaactgcttgagtggaaaggcagcatcctggcctccctgtggccggcactcaggtcaaagggtctcctcttcaggggctacaggataactatgaagatatggctggcatctcggaggagcttcctttgccctgttatgagcaggccatcaccactggagaaaaggcccagaagcaccaaggcacgagatgtgcccagggagcagtaagaatcaggggctggtgcagggcctggcaggaggctggggcacaaaggggaagattctgaagggctctgagcac

SEQ ID NO: 8492 - DNA, 984 bp, Homo sapiens
  ENST00000559317
tcaaacttcggtggttctgaaagaaagaaaggctgggcaggcaacccgcctaacagagcttattatcagtgtggcttacaggaccacttcaaaaaggactgcccaaacaataagctgccccctcgtccatgtcccttgtgccagggggatcactggaaggcacactgcccccgagggcgaaggttcactgggccagaggccactaaccagatggtaccacaacaggactgagggtgcccggggcaggcaccaacccatgccatcaccatcacagagagccccagatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatgggtatttttggcaactcttctaattaatttccctgttatttatctccatgattgcatttgggtcgactaaaactgtgtgcagcaggggtaaggtgtttcatctctgcacagtttaaggccggtttaactcttacctagaagccattgcgttccgggataccaagggtatacttcttggtcccaccttgacagatgtttatttcaaactggagaagccgtctcctgggaactgactcgcacccttctgctgcagatgggaggtggaaggagcaggagcccacagccctgggaggggcattctgtgggccgtgtgacagctggtgctggtgcatgctctttcgaggctcagctcctgccttgccctctattgcctcctcctgcccagcgaatctgtgtttggttgaaaatcaatgaactgatgttggcccctggtaaggcatttcttggctagaggaatagctcaaactgcttgagtggaaaggcagcatcctggcctccctgtggccggcactcaggtcaaagg

SEQ ID NO: 8493 - DNA, 2029 bp, Homo sapiens
  ENST00000464150
accattgtgtatgattcgttgttgactgcagcatcactaggtgggacatcactgcgttttccttgaacttccgcgggttctcctaaagttacttggtgactttttatgattgctttctgctcgtctgaataaaggatgagcccagggcctgctgcccactgtctgctctgatgaccctctctcccctgcagatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatgggtatttttggcaactcttctaattaatttccctgttatttatctccatgattgcatttgggtcgactaaaactgtgtgcagcaggggtaaggtgtttcatctctgcacagtttaaggccggtttaactcttacctagaagccattgcgttccgggataccaagggtatacttcttggtcccaccttgacagatgtttatttcaaactggagaagccgtctcctgggaactgactcgcacccttctgctgcagatgggaggtggaaggagcaggagcccacagccctgggaggggcattctgtgggccgtgtgacagctggtgctggtgcatgctctttcgaggctcagctcctgccttgccctctattgcctcctcctgcccagcgaatctgtgtttggttgaaaatcaatgaactgatgttggcccctggtaaggcatttcttggctagaggaatagctcaaactgcttgagtggaaaggcagcatcctggcctccctgtggccggcactcaggtcaaagggtctcctcttcaggggctacaggataactatgaagatatggctggcatctcggaggagcttcctttgccctgttatgagcaggccatcaccactggagaaaaggcccagaagcaccaaggcacgagatgtgcccagggagcagtaagaatcaggggctggtgcagggcctggcaggaggctggggcacaaaggggaagattctgaagggctctgagcaccagtcctggggagccggggtcagggcagatccacctgaagaaagctggcacatgctgtggtgggagctcaaagacagagggtaagaaactactcaggaggctcctacgaaggcctggctctcagccacccgtcaaagccactgctgagggcagagggaggttgttttcagccggagactccactgcaccatcttattttcaacctcttggctctgctacccaaactcacttggactggccctggacgagaagaaatggtagaaaattcttccagacagcaattactcctttggtcacctccactcttattctcattagcaattgaagtaagggccagtggagagggaaaaattgtcgagcacctctgacacttggcagtgcctacctgcttgtgttccagagggcagcttcagagaaaacgggcacacaccgtccaagccagctcaatcctcagaaggccagtaattaccattggaattacacagcagcaatggatcgttcatataggataataattataattatacatgagcatcgctgtagaataatgatgcctattggcttatcctgggaagactccaaaaatgtgattcagtcctgaggcctcggcaatgggcatgatgagggcaggctcaggggcaggagggcaccctgctagagctgggtgtggggcacgtaggaaaggggtggttttcaaaaaggcttgagacagatccctggccttgaggatgtgcttcgcatgcagcctgcaacccagggagtgcagaaaagaaaaagtgcatttgtttatggagcacatatttgtgtggcaggtaccattctagatgctggagattcagaaataagcccccctcctccaccttcacgaggcttacatcctagctgggagagacggataataaataagataaataaatag

SEQ ID NO: 8494 - DNA, 4584 bp, Homo sapiens
  ENST00000396399
accattgtgtatgattcgttgttgactgcagcatcactagatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatggggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccataccaaatgatgataccttggttggaaaagctgatgagaaagccagtgaacaccattccccacaagcagaatccatgatcacttccattggaaacccagtgcaagtactgaaagtgacagagacatttgggacttggataagagagtctgctaacaagagtgatgaccggatttgggtgacagagcatttttcaggcatcatggttaaggaattcaaggatcagccctcacttctgaatggcagttacacgttcatccaccttccatactatttccatggctgtgggcacgttgtttacaacaactctctctactaccacaaagggggttctaataccctagtgagatttgaatttggccaggaaacatcccaaactctgaagcttgaaaatgccttgtattttgatcgaaaatacctttttgcaaattccaaaacttacttcaatctagctgtagatgaaaagggcctttggattatctatgcgtcaagtgtggacggctcgagcattcttgtagcacaactggatgagaggacattctcagtggtgcaacacgtcaataccacgtaccctaaatccaaggctggcaacgccttcattgcccgaggaatcctctatgtcacagacaccaaagatatgagggtcacatttgcctttgatttgttaggagggaaacagatcaatgcaaactttgatttaagaacttcccagtctgttcttgccatgttagcatacaacatgagagatcagcatttatattcatgggaagatggccatttaatgctttatcctgtgcagtttttgtcaactaccttaaatcagtgatgtgctgcattcggctcccttcagcaaatttcaggggttttctgggaccagttctcccccaacaggaaacttgtttttttaacgtcagccagatatttagaaaataacctcaaaagtgtttatatggtcagtgagccccgcttagtgaaatagcaacagattggaagttgaaatggctgagatttggtgatctccccacagctggctctgcaagttacctctttctccttgggccttagtttccccattggtaatctgaattggctaagatgattggggagattttctgtacctgtaggtaatttggtgattcttggtggctgctcttctcacaacttttatgtatctgcttctgtcgtttagcttttttagccacatgctgaccaaatttacctttgagttgataagtccagtggcttgagtagtgaatccctcagtgctgacttatatcttgttctttgaaaaaatgcattgactctttaagacatctaaagtatcacattatccataatttattgcttttctttgcatctgcacctgccaccacagaataaccattaccctcagctgctgattgggcagctctgagattagcaaaagccagggacagctacatgttcaggtttttttttttttttttttttcaataagctattttttttcttttcttattttaaatagagagagagtcttgctatgtttcccaggctggtcttgaactcctggggctcaagtgatcctcctgccttggcctcccaaaatgctggattacaggcatgtgtgcctggcccaggtttcttaataaaacagaatcatgatcttccaggttccccccagtttctgatcatgttgatttgtagctgtggatcatgaacactgaatcctcagatcactctgacttcttatgcttctcctgtggatccactatcaaagtactaaatgctgtgtaagtagacgttaatctggctggaaccatgggaagcactttgcagtgttcagaagagaggctccatttgtggctattatgtagaactgggccagagccagtccattgcctgtttttttaaataaggttttactgagcacagccacactcatttgtttatgcagtacggcctgacattgcttttgctctgcaacagcagagtcgagtcattgcaacaaagagcatatggccccacagtgcctaaaatattgaccagctacccctttatggaaaaagattgctgactcctgataaagaatataaagtgagcctgattcttgaaaaaatcagaaccagagcctgttttgttttgttctaaactaagaagccgcataggatgtgacttgcgttttgagtagaggggaaggctgataacggcgtaagatgaagtggccctccacaaaggctggttaggggacagttctttctctaacatagttttaaaggatgtgatctggtccccttggatgccaggagagaatccagttgaacttgctcctaaatgctcttaaatatgcatattttctgccaactcacttctttaaacatctttcagcccagcgctgcggccccgggaagggccactgcgaatagagaggaagctggaaaagttcctggggctctgcagccaggaaggggaaccagggcaaatcttatgtaaagatttttcagcaacttgtcccaatttgtgtgtattctgaaactttctctttgggaccaaattcattctcaatggccctgagttcaatatattattaacagcagtattttaaaacttagggttgaactgggcatggtggcacataactgcaatcccagctactttggaggcagggatgggaggatcacttgaggccaggatctcaggaccagcctagagagatcccatctctaaaaaataaaatataagaaaataaaacttaggggatatacagatttaaatattcaaatctccctgctcccctgaaagtccccaggcagctgtcaatgacttgtttgttgtgttctcaatatgatggctatttgaaacttcacctacttttcattagattggttgtaccatgtcaccttagcttttaaaaatactcttttcagattcacgttctctaacaaagagtctcatgttcaagatcaatatgtctaataagtgctggtgtccttttaaagtatttaaatatatatgttgctgttgctgaatacaggagaccaggttaggaatatagtttcataataatagtacatacaatactaattgtatataaggtagcaaccaaaagaggttgttaattagcacatattccttttagaaaaatgtttcagaaacctcagtcttgatatctgagctatctgggctcccttacttgtgagtaagggatcatgctcaccactggagaagcttacaccgggactttttttcttttttcttttttttttgctatgacagagtaatgctaacgtaaggacaactgagtttgatcagtgtttaatcgcagtgggtaatcttatctgattgtctttaaaagtgaaaaggattaagattttattctttcttgtaaacattacttgattttttaaagaagttttgggctcactgctaaaatagagtatacaactgaatgtttttaagtcaagatactgttttaggagtttaccctctcatttataaccaaagttgctctaaaacactttccaaatatctgcacttctgatgtcagaatcaaaccagataattctctaattcttctttaatctaaagtagatagcttcccactggaaagtaaacaaaaccatccctcccaacctcaaagctaggccacactctatttcaaggcattttctttcagctgataaggtgtcctcctgaagccaagtaggtggttctggtctccaagtatcgttaagcacaggtgctatgacagaaaaagttctggggtggaagttttaagatgaggagttctgatcttaggcatcttaacagtcacaaggtgaaaagtcaaatgaaacagtacaattcttgatgagtgaggtgtcatcttccaaccacacagaggacgttttggctatgatcatctgatggcaagtgaaggagaaatgagtgatagggctttgcgttttcatccagatgctgtggccctgtgtttcacagcattaagagccataatttccaacctgcacagatcctgaacaacaaatgaataacgatgaatgtctttttggttgtaatttaacaagtcaaataaaataatcattgctgagcacaatcaca

SEQ ID NO: 8495 - DNA, 591 bp, Homo sapiens
  ENST00000561194
acttggtgactttttatgattgctttctgctcgtctgaataaaggatgagcccagggcctgctgcccactgtctgctctgatgaccctctctcccctgcagatccgagtgatggtggacctgtgcaacagcaccaagggcatctgcctcacaggacctccgggagccggcgggttgccaggacacaacggattggatggacagcctggtcctcagggcccaaaaggagaaaaaggagcaaatggaaaaagaggaaaaatgggtatttttggcaactcttctaattaatttccctgttatttatctccatgattgcatttgggtcgactaaaactgtgtgcagcaggggtaaggtgtttcatctctgcacagtttaaggccggtttaactcttacctagaagccattgcgttccgggataccaagggtatacttcttggtcccaccttgacagatgtttatttcaaactggagaagccgtctcctgggaactgactcgcacccttctgctgcagatgggaggtggaaggagcaggagcccacagccctgggaggggcattctgtgggccgtgtgacagctggtgctggtgca

SEQ ID NO: 8496 - DNA, 571 bp, Homo sapiens
  ENST00000558426
ggtgactttttatgattgctttctgctcgtctgaataaaggatgagcccagggcctgctgcccactgtctgctctgatgaccctctctcccctgcagatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatggggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccatacca

SEQ ID NO: 8497 - DNA, 1676 bp, Homo sapiens
  ENST00000612989
tgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatggggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccataccaaatgatgataccttggttggaaaagctgatgagaaagccagtgaacaccattccccacaagcagaatccatgatcacttccattggaaacccagtgcaagtactgaaagtgacagagacatttgggacttggataagagagtctgctaacaagagtgatgaccggatttgggtgacagagcatttttcaggcatcatggttaaggaattcaaggatcagccctcacttctgaatggcagttacacgttcatccaccttccatactatttccatggctgtgggcacgttgtttacaacaactctctctactaccacaaagggggttctaataccctagtgagatttgaatttggccaggaaacatcccaaactctgaagcttgaaaatgccttgtattttgatcgaaaatacctttttgcaaattccaaaacttacttcaatctagctgtagatgaaaagggcctttggattatctatgcgtcaagtgtggacggctcgagcattcttgtagcacaactggatgagaggacattctcagtggtgcaacacgtcaataccacgtaccctaaatccaaggctggcaacgccttcattgcccgaggaatcctctatgtcacagacaccaaagatatgagggtcacatttgcctttgatttgttaggagggaaacagatcaatgcaaactttgatttaagaacttcccagtctgttcttgccatgttagcatacaacatgagagatcagcatttatattcatgggaagatggccatttaatgctttatcctgtgcagtttttgtcaactaccttaaatcagtgatgtgctgcattcggctcccttcagcaaatttcaggggttttctgggaccagttctcccccaacaggaaacttgtttttttaacgtcagccagatatttagaaaataacctcaaaagtgtttatatggtcagtgagccccgcttagtgaaatagcaacagattggaagttgaaatggctgagattttctgtacctgtaggtaatttggtgattcttggtggctgctcttctcacaacttttatgtatctgcttctgtcgtttagcttttttagccacatgctgaccaaatttacctttgagttgataagtccagtggcttgagtagtgaatccctcagtgctgacttatatcttgttctttgaaaaaatgcattgactctttaagacatct

SEQ ID NO: 8498 - DNA, 784 bp, Homo sapiens
  ENST00000532291
accgcacaccccccagcccagactccagccctggaccgcgcatcccgagcccagcgcccagacagaggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgca

SEQ ID NO: 8499 - DNA, 3613 bp, Homo sapiens
  ENST00000228682
gcacaccccccagcccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacagaaggactgtctggcccgcccttctgccaccaagctaacctcatgtccggcccccacagttatgggccagccagagagaccaacagctgcaccgagggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccatgcacaagatgccccagggatgggaggtatgggctgggggctatgtatagtctgtatacgttttgaggagaaatttgataatgacactgtttcctgataataaaggaactgcatcag

SEQ ID NO: 8500 - DNA, 480 bp, Homo sapiens
  ENST00000528432
ggttaagtttaagaggctggagggatggctagctggaggtctgcgttgtagagaggtaaccccagtgtccccacaccctcctctgagacgccatgttcaactcgatgaccccaccaccaatcagtagctatggcgagccctgctgtctccggcccctccccagtcagggggcccccagtgtggggacagaaggactgtctggcccgcccttctgccaccaagctaacctcatgtccggcccccacagttatgggccagccagagagaccaacagctgcaccgagggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatga

SEQ ID NO: 8501 - DNA, 314 bp, Homo sapiens
  ENST00000530789
ggatggctagctggaggtctgcgttgtagagaggtaaccccaggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgaggtgcagtcagccccgggccaagaggcccctaaagcccctacccaagtccattaaaagtctcaagccctcaaacta

SEQ ID NO: 8502 - DNA, 3196 bp, Homo sapiens
  ENST00000528467
atgttcaactcgatgaccccaccaccaatcagtagctatggcgagccctgctgtctccggcccctccccagtcagggggcccccagtgtggggacagaagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcct

SEQ ID NO: 8503 - DNA, 676 bp, Homo sapiens
  ENST00000527742
agaggtgtgggtgctggggttcactccttgcagttgagtcagacgcttccaaatgggatcccaccttttgcccatcccattcaccagtgtagtctgaggaggaagtcccttccaaacccaggaggttccagctgcttgggtgggggcacttagggcaggaagacctggcttggtttcctcttccttctgcttacttccaccctcatcaccgtcacctcttcccctggggaagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcacgtgagccccagggggtaacaggaatggctagccagaacctttaggagattctgagtgggacatggtggaatccggctgagggcaggaggtcagaggagactgaggttgaatgctcagttgggtaggcagaagctcagaagttgtagctttgccttagggagctggaagacctgagatgtgagatatgatattgctcctgcctcttcctccttgagg

SEQ ID NO: 8504 - DNA, 3394 bp, Homo sapiens
  ENST00000543426
accgcacaccccccagcccagactccagccctggaccgcgcatcccgagcccagcgcccagacagaggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccatgcacaagatgccccagggatgggaggtatgggctgggggctatgtatagtctgtatacgttttgaggagaaatttgataatgacactgtttcctgataataaaggaactgcatc

SEQ ID NO: 8505 - DNA, 3475 bp, Homo sapiens
  ENST00000546141
cccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacagaagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccatgcacaagatgccccagggatgggaggtatgggctgggggctatgtatagtctgtatacgttttgaggagaaatttgataatgacactgtttcctgataataaaggaactgcatc

SEQ ID NO: 8506 - DNA, 567 bp, Homo sapiens
  ENST00000482119
taaaaaaagtgtcggagattggcgcgtcctttggttcctttctcgaactttccttgtaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggtgtgcacgggccccctgccctcagcggcagccctgtcatctctgacatctccttgatccggctttccccgcacccggctggccctggggagtcccccttcaacgccccccacccgtacgtgaacccccacatggagcactacctccgttctgtgcacagcagccccacgctctccatgatctctgcagccaggggcctcagccccgctgatggtgagtagggtgtggggatgg

SEQ ID NO: 8507 - DNA, 864 bp, Homo sapiens
  ENST00000472722
taaaaaaagtgtcggagattggcgcgtcctttggttcctttctcgaactttccttgtaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggtgtgcacgggccccctgccctcagcggcagccctgtcatctctgacatctccttgatccggctttccccgcacccggctggccctggggagtcccccttcaacgccccccacccgtacgtgaacccccacatggagcactacctccgttctgtgcacagcagccccacgctctccatgatctctgcagccaggggcctcagccccgctgatggtgagtagggtgtggggatggggaggggcagctagggcactggggcagggcgcagccagcctctctcacgctaacactgtcaactcctcagccttggtccccttgaatggtgaccaggctggctggcgttccttcacactacttccaaacaacaagtttttgggttttatgctcattaaagagcctttggtaagcactcttttgcatgcaaaccatatatgatctattgtaataataacagtaagggtctatccaggtaggtcctgtgtagctgagaaccactggttgtaaccaaccaaagcctgcagaagctggtgt

SEQ ID NO: 8508 - DNA, 315 bp, Homo sapiens
  ENST00000418323
ggccacctgcgtgctagaggcaaacttttgtctctctcggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggt

SEQ ID NO: 8509 - DNA, 3724 bp, Homo sapiens
  ENST00000438299
tgaagttcgtggactcctacaataatgctataaatgcatagaagaaaagacacaggactgtgaaagaaagtgatgatgcgatgtctaaaacgttcaaggcaccgcatctgtgatcaagaatacatgtgctgctttaccgacacatcaaagagcaaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccag

SEQ ID NO: 8510 - DNA, 3673 bp, Homo sapiens
  ENST00000452692
tgaagttcgtggactcctacaataatgctataaatgcatagaagaaaagacacaggactgtgaaagaaagtgatgatgcgatgtctaaaacgttcaaggcaccgcatctgtgatcaagaatacatgtgctgctttaccgacacatcaaagagcaaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccag

SEQ ID NO: 8511 - DNA, 4955 bp, Homo sapiens
  ENST00000445186
tgaagttcgtggactcctacaataatgctataaatgcatagaagaaaagacacaggactgtgaaagaaagtgatgatgcgatgtctaaaacgttcaaggcaccgcatctgtgatcaagaatacatgtgctgctttaccgacacatcaaagagcaaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagacgccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagccccagcaccatcagtggggccctcaaccagttcccccaatcctgcagcaacatgccagccaagccagggcatctggggcaccctcagcagacagaagtggcacctgaccccaccacgatgggcaatcgccacagggaacttggggtccccgattcagccctggctggagtgccaccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcaggctttggcctagtgcagccccggcctcccctcgagcccagccccactggccgccaccgtggggtacgtgctgtgcagcagcagctggcctacgccagggccacaggccatgccatggctgccatgccgtccagtcaggaaacagcagaggctgtgcccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccag

SEQ ID NO: 8512 - DNA, 4904 bp, Homo sapiens
  ENST00000341310
tgaagttcgtggactcctacaataatgctataaatgcatagaagaaaagacacaggactgtgaaagaaagtgatgatgcgatgtctaaaacgttcaaggcaccgcatctgtgatcaagaatacatgtgctgctttaccgacacatcaaagagcaaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagacgccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagccccagcaccatcagtggggccctcaaccagttcccccaatcctgcagcaacatgccagccaagccagggcatctggggcaccctcagcagacagaagtggcacctgaccccaccacgatgggcaatcgccacagggaacttggggtccccgattcagccctggctggagtgccaccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcaggctttggcctagtgcagccccggcctcccctcgagcccagccccactggccgccaccgtggggtacgtgctgtgcagcagcagctggcctacgccagggccacaggccatgccatggctgccatgccgtccagtcaggaaacagcagaggctgtgcccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccag

SEQ ID NO: 8513 - DNA, 6799 bp, Homo sapiens
  ENST00000452319
tgctgctttaccgacacatcaaagagcaaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggtgtgcacgggccccctgccctcagcggcagccctgtcatctctgacatctccttgatccggctttccccgcacccggctggccctggggagtcccccttcaacgccccccacccgtacgtgaacccccacatggagcactacctccgttctgtgcacagcagccccacgctctccatgatctctgcagccaggggcctcagccccgctgatgtggcccaggagcaccttaaggagaggggactgtttggccttcctgctccaggcaccaccccctcagactattaccaccagatgaccctcgtggcaggccaccccgcgccctacggggacctgctgatgcagagcgggggcgctgccagcgcaccccatctccacgactacctcaaccccgtggacgtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagacgccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagccccagcaccatcagtggggccctcaaccagttcccccaatcctgcagcaacatgccagccaagccagggcatctggggcaccctcagcagacagaagtggcacctgaccccaccacgatgggcaatcgccacagggaacttggggtccccgattcagccctggctggagtgccaccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcaggctttggcctagtgcagccccggcctcccctcgagcccagccccactggccgccaccgtggggtacgtgctgtgcagcagcagctggcctacgccagggccacaggccatgccatggctgccatgccgtccagtcaggaaacagcagaggctgtgcccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccagaaaaaggaaagaaaaaatgtactccttggggcaagcccagaagctgccctggcctctccagaccgtgtttacagtgtttgcatgtagaatgtagcccttcctgaaaagaagacttgtttctaaatacctcggggctgctggagccgctgtgggttagggatggactgaggcctcgaggagtgagggtgcacccggggcccagcctcaggctgccctagggatctctcagtaggaagaggaagttgcgtgtttacccaatcctgtttctccaatgcaacgtccacccactttaccaccaaaaactccagggcctgacggcagcccggtcccccagcactcaccagcagcccagtgttctccaccaagccacagtgtgcatgcctggtatcctccggattcccttccttctgcccgctgagtcactgggcagagaatgatgacatgtgtaggtggtgtggttgggggtggaaaggggaaggggttgatcctcaggactctgagggagcatcgttgaattttcctgttcagtgtgaccaagacccacctggaaatggaatttggaactggcttcaggagacatcattcctgaacacactgtagggtgaattggtgcatcttccccaccatacacacacacacacacacacacacacacacacacacacacacaccccaaaccttttcatggggaatgtgtggcaaccttgccaaacagcaccactcagagtgtgactctgactgtgaccttggccttaatgaggaacttcttaggagagtttgaggacaaggccaacatcgtcatctgggctcgctgcgtcccagcacatcaaactctgtccagagacaaggccaactgcaaatgaaagccagggaacattgctaagggtctgtggctctgtggtggtgttcatcgccttcctgagataggatttcccttgccagtcccaacctgtatatattctgtacagaagacatccctgaatatactgtaggtgagtcgtccagccaaatttatatctccaaaacatttttagctttttctacatgctatgaattgagatgacatgctcaacttgtaaataagtctttttgtacattaaaaaagtaattttttcataatttatcttgtctatctgcttcccccttgacagtagttaatgagaacctgggcagtaaatttggtgcattcgagcagaaattaggctgtattttttcttaacagtgtcaaaattgactatcccgcctttgccaagaaatgtttaatgctgaggca

SEQ ID NO: 8514 - DNA, 1904 bp, Homo sapiens
  ENST00000437950
gattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgacccc

SEQ ID NO: 8515 - DNA, 2088 bp, Homo sapiens
  ENST00000435313
ccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggtgtgcacgggccccctgccctcagcggcagccctgtcatctctgacatctccttgatccggctttccccgcacccggctggccctggggagtcccccttcaacgccccccacccgtacgtgaacccccacatggagcactacctccgttctgtgcacagcagccccacgctctccatgatctctgcagccaggggcctcagccccgctgatgtggcccaggagcaccttaaggagaggggactgtttggccttcctgctccaggcaccaccccctcagactattaccaccagatgaccctcgtggcaggccaccccgcgccctacggggacctgctgatgcagagcgggggcgctgccagcgcaccccatctccacgactacctcaaccccgtggacgtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccga

SEQ ID NO: 8516 - DNA, 529 bp, Homo sapiens
  ENST00000360874
gcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggtgtgcacggtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcagcccagccttcaccttcccccaccccatcaaccccgtggcctaccagcagattctgagccagcagaggggtctggggtcagcctttggacacacacca

SEQ ID NO: 8517 - DNA, 1112 bp, Homo sapiens
  ENST00000433812
gcctccgagaagcaagaagccaaaagtgggatcctggaggccgctggcttccccgacccgggtaaaaaggcctctcctttggtggtggctgcagcggcagcagcagcggtagctgcccaaggaggccccctgccctcagcggcagccctgtcatctctgacatctccttgatccggctttccccgcacccggctggccctggggagtcccccttcaacgccccccacccgtacgtgaacccccacatggagcactacctccgttctgtgcacagcagccccacgctctccatgatctctgcagccaggggcctcagccccgctgatgtggcccaggagcaccttaaggagaggggactgtttggccttcctgctccaggcaccaccccctcagactattaccaccagatgaccctcgtggcaggccaccccgcgccctacggggacctgctgatgcagagcgggggcgctgccagcgcaccccatctccacgactacctcaaccccgtggacgtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcaggagcagctggctgacctcaaggaagatctggacagggatgactgtaagcaggaggctgag

SEQ ID NO: 8518 - DNA, 6768 bp, Homo sapiens
  ENST00000361492
gattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggtgtgcacgggccccctgccctcagcggcagccctgtcatctctgacatctccttgatccggctttccccgcacccggctggccctggggagtcccccttcaacgccccccacccgtacgtgaacccccacatggagcactacctccgttctgtgcacagcagccccacgctctccatgatctctgcagccaggggcctcagccccgctgatgtggcccaggagcaccttaaggagaggggactgtttggccttcctgctccaggcaccaccccctcagactattaccaccagatgaccctcgtggcaggccaccccgcgccctacggggacctgctgatgcagagcgggggcgctgccagcgcaccccatctccacgactacctcaaccccgtggacgtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagacgccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagccccagcaccatcagtggggccctcaaccagttcccccaatcctgcagcaacatgccagccaagccagggcatctggggcaccctcagcagacagaagtggcacctgaccccaccacgatgggcaatcgccacagggaacttggggtccccgattcagccctggctggagtgccaccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcaggctttggcctagtgcagccccggcctcccctcgagcccagccccactggccgccaccgtggggtacgtgctgtgcagcagcagctggcctacgccagggccacaggccatgccatggctgccatgccgtccagtcaggaaacagcagaggctgtgcccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccagaaaaaggaaagaaaaaatgtactccttggggcaagcccagaagctgccctggcctctccagaccgtgtttacagtgtttgcatgtagaatgtagcccttcctgaaaagaagacttgtttctaaatacctcggggctgctggagccgctgtgggttagggatggactgaggcctcgaggagtgagggtgcacccggggcccagcctcaggctgccctagggatctctcagtaggaagaggaagttgcgtgtttacccaatcctgtttctccaatgcaacgtccacccactttaccaccaaaaactccagggcctgacggcagcccggtcccccagcactcaccagcagcccagtgttctccaccaagccacagtgtgcatgcctggtatcctccggattcccttccttctgcccgctgagtcactgggcagagaatgatgacatgtgtaggtggtgtggttgggggtggaaaggggaaggggttgatcctcaggactctgagggagcatcgttgaattttcctgttcagtgtgaccaagacccacctggaaatggaatttggaactggcttcaggagacatcattcctgaacacactgtagggtgaattggtgcatcttccccaccatacacacacacacacacacacacacacacacacacacacacacaccccaaaccttttcatggggaatgtgtggcaaccttgccaaacagcaccactcagagtgtgactctgactgtgaccttggccttaatgaggaacttcttaggagagtttgaggacaaggccaacatcgtcatctgggctcgctgcgtcccagcacatcaaactctgtccagagacaaggccaactgcaaatgaaagccagggaacattgctaagggtctgtggctctgtggtggtgttcatcgccttcctgagataggatttcccttgccagtcccaacctgtatatattctgtacagaagacatccctgaatatactgtaggtgagtcgtccagccaaatttatatctccaaaacatttttagctttttctacatgctatgaattgagatgacatgctcaacttgtaaataagtctttttgtacattaaaaaagtaattttttcataatttatcttgtctatctgcttcccccttgacagtagttaatgagaacctgggcagtaaatttggtgcattcgagcagaaattaggctgtattttttcttaacagtgtcaaaattgactatcccgcctttgccaagaaatgtttaatgctgaggc

SEQ ID NO: 8519 - DNA, 8208 bp, Homo sapiens
  ENST00000395925
gtctatgggaagttcggggacttgacagccgctgccgccgcagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatgaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccggaaccccactgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgccgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtgggacaggggtacctggctcaccagctcctcggcgacagcatgcagcacccgggggcaggccgccccggtcagcagatgcttgggcagattagtgctacctcacacatcaacatctaccaagggccagagagctgcctgccaggggctcacggcatgggcagccagccgtcaagcttggcagttgtcaggggctaccagccatgtgccagctttgggggcagcaggcgccaggctatgccgagggacagccttgctctgcagtcaggacagctcagtgacacaagtcagacctgcagggtgaatggtatcaagatggagatgaaagggcagccccatccgctgtgctctaatctgcagaattactctggtcagttctatgaccaaaccgtgggcttcagtcagcaagacacgaaagctggttcattctctatttcagacgccagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaaaaaaaaaactgtaagccccgccccctttttagtaaaccgatgtaaatttgtgatgtgcatattcttctttcttttagaagagcagtcaaattaaaggatttgacatgttttgctgttgctcaaaggaaataggagttggtgtgcttgtgaccaaggggttacacttccagcttttaaaattctcctttacatgtgctcagtgttttgttttgtgttttggtttctgttttttattttaattcccacattgggcacaagaatcagaatatggatagctagtttaagaaacttttgtgggtgcactgtagcatagatgacagaatattgatgttccccccatctccaattcagttcagggcattccacagttaaacagaaatgggaacgtggggctcttataaatgaaatgggcgctcacagttttggttttcagctcttcatgtctgtaagtgtgctttgggggaggctatgtctgtatggtcgattctcagttatcacatttgcctctcctcccactaccttcatgaacattcagtgctgtttcgcactgcagttagagagaagggacggacagttggtgacactcagccacattgctacttttatctgttctggtaagaagttagatagatggtagattgaagcaattgggtagaattagttgggggaatatttatgagttgctgtgtttgttgattagttccatctctttcccattttaactgagaattgattatatatagctctaagtatataggtatttaaacaaccccacaagcggctgtatcagtaacatttattaattccactatagtgagggaggatttccattctaaataccttattttgagggatttataaaacttagttgtaaaagagaaagcccacatagtgggaataaattgcttcagccatttttagtatttgagagcactagggaagatgtttagtagctgtgtggatgccttttttcacaccctgtctattgaatgctgcatccattcacgaagttaaatgttacatgcagttagtccttaatgtggactggatctgtacttttgttttggattaaaacatttaaagatttttgaagtgcagctactccccacgtgcatttgatacacataaaagtcatactgtgtgtgcacaaagagtacatggattttccagcatattgctttaaaaaattatataaactgttaaaatattaacacctcaggctacctgctgtattctgtcccattgacccctggaattggatttactgcaagtgattgataattcaattatgtggcttttcccctttaatcttgccatttaaattacagtagaaagacaaaatcaagtaaaataaagtgttagataatagaaagagtgttaagaccagcccacttttctcatgtttatgttctttcatttggaccaagaatctccgcatggaggttgatttgccactggggactttggctaagactattaggtttgctttcaactagatgttcctgagacaagcagagggacactgcaattccccttccatgcctgctgttctcccccatgtaagtcttctttgaaattaacggatgtgtctcctttggaacagccccataacaaaagagaactactgatctgagcataggaaagtagaggctctaccacttttcagttgaaaaagcaagactttctctgtgtttctgaaacaaggcataatgttgtcacagaatcagagatccagtctcacttttccacaaatctccaaatctccagtcttatcttgtgtgctctaatggtttggttcaatccctttccaactcttgttttcaaagcatggggcctgagtgttctccactcctcctaagaaaggagcttgggtggaagggaccatgctgacctcctccatcagagggctcttccagtagtattctcggatgcaacctccatttctcagttaccattatttcctgtatcagctttgtccttcctggagggatgcacagtgatccggcccaccactgttgttgtcttgtgcttctgctctttcctatggtttcaggttattttctgggtttcccctattcttcttttatttctttttttttttatatttgctttcctttctactgcttttagatttgcaggagatgcaagtttcagctcaatgtttggcttctctcaatatggaaatttcagaaggacagaggagaggagggaggaagaagaaagtatactcctccagaatttcagtgatctgttgtggcagtccagtggaaggaaggtcttttgaggtcacttagaagcatctttttgggacatccttttgggatctctgtaggctaggcatctcatatcttgagactcacccccagcctccaagcctctctccatttctctaacctatgcattttagagcgagaggaccgcctcactagtgtcaccatcctgccttttctaaaacatgcaggctcacacattctactcctgcttaatgtctgtgttaaacgttttctaaccatttttgttttatttttctgaaaaagttaacccctcccaactcctcacacattggctcttcctcttgagccacaaagttttgattcttgcgatgtatgtgccttattttatgttaatcttgtcaatgagagggaccagttggtgttgcccaatcagcactccaaggctgtgtgtgcaccagccagagagcgcacggtggtagcagagtcgaggctgtcttgtatcctggtttcatgtgttgttttgaactgataggaggatgttctcttctgacaagttacccttgtgtatcctgcagacatgtaaaataaaatacaagttcatttttttcaccttttttagatttttttaaaaaataaaatgtgtaatcctttttttaaaagaaacacatgtaaatacatttaagtattgtaggcatagcgttcagatgtgactggcccaggcgttcctcggacaagcctgcattccccgtgatcacgcccacctcaagcccaggggctgcagcccagccacagatgaactctacctttgctttcagaaccacttagtccttttgtaacaaagaaaaaaaaatgtttcttacaatgtcaataaaaaattctttgtatggaa

SEQ ID NO: 8520 - DNA, 4968 bp, Homo sapiens
  ENST00000479210
agagagataccgagaatgttcctagagggtctgcgcagctagagagagctcaccaagagaagttggcgcaaagtagctagccagagcctggggactgtgttaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccggaaccccactgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgccgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtgggacaggggtacctggctcaccagctcctcggcgacagcatgcagcacccgggggcaggccgccccggtcagcagatgcttgggcagattagtgctacctcacacatcaacatctaccaagggccagagagctgcctgccaggggctcacggcatgggcagccagccgtcaagcttggcagttgtcaggggctaccagccatgtgccagctttgggggcagcaggcgccaggctatgccgagggacagccttgctctgcagtcaggacagctcagtgacacaagtcagacctgcagggtgaatggtatcaagatggagatgaaagggcagccccatccgctgtgctctaatctgcagaattactctggtcagttctatgaccaaaccgtgggcttcagtcagcaagacacgaaagctggttcattctctatttcagacgccagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctcttttt

SEQ ID NO: 8521 - DNA, 553 bp, Homo sapiens
  ENST00000464291
actgaaaactctttatctggaactacaccaagctacatctgaatcccaataaatgcagagtttagtggactttttgttcctgggttttgaaaagctgctgacccttgaaacatcagtttttcatcaacttggagggcgtgttaggcataagctgctgttgccattgtgcagagtaatccagatttacctgttgtcctcagtttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccg

SEQ ID NO: 8522 - DNA, 653 bp, Homo sapiens
  ENST00000448703
tgcggttctcttgctcgctttctgttctcttgcttactttcaaatgcagacgtgcactacagcgtcaccagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatgaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccgg

SEQ ID NO: 8523 - DNA, 451 bp, Homo sapiens
  ENST00000437480
gcggccgcgcggagcggggagccgccagcctgcgccccgtccgcgggtctatgggaagttcggggacttgacagccgctgccgccgcagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatggcaaccatttggaggcccaggccagaggctggaccaggaggattggatgcatccgcgctgtccatccctgctgctgcacaaacgactcagccacagatcctcttggatgggctaccttgaaagggggaagctccaaagaatgcgtacaaacccatacatttacctaggtgcgggatgattgcaagaccactttatt

SEQ ID NO: 8524 - DNA, 583 bp, Homo sapiens
  ENST00000428534
agctgggacccactccgggcttggggacccggcgggcgggagaagcgggggctcccggcgcggcctggaaggagcgagaaagcaaaaggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatggtgagcagcacagggattaccagcagcccagcctggagtcatttctgtgttctctgcattccttgtgaattgagcgtttgcacctggaccagtgtttgttctaggagacgctaaagaaagcaaatggagcaggggcggggggacggcggggggacatggaatgtagtaatctctattttggcactcaacctacacgttgacttccaaactttctaatttgagatgtaaatgtgataggttatttattatcagaagttcctgttttggcattttggaaatcatcttgactagtctggcaagagttcaaaatgctttgtgttgcatatggat

SEQ ID NO: 8525 - DNA, 5877 bp, Homo sapiens
  ENST00000266659
agaacacaaagtgagctgcacaccatatatggagaaacccgtttcttaaaactagtgatgaactcatgctctgttctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtcaaacgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtagccttcattagttaaaaacattattattttttgcatgctgcttcgactctaaatatctggttttccctgtctttttggtttactacttccccagattcagaacagaggagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacaaagacttatataccactttctcgtataaatttttcaaaaaatacaataataatataatttataaagaacactcttctatgaacaaccaccaccaccaaaaaaaaaaaaagccctcagaaaatttctcacaaataaggcaactaatgcctgatatctcaaaatcctttacaaaaggagatagttctagtcaaggagttttgggtatgttacttttttttcttctttttcttttcatctgcctccatcttaagtgcaatttcttcagctgtaagagctcccagtttcttattctttgctttcttaaccttttccttgatgctggccacatcaattttagtttcagtagaagctagacaaattaaaagcacaacacatgtaatactttagattttaccaagtaaaacaaagaatatatgtttaacaaagaatatatgtttaaggcagttaacttcagagtattcttataattgaataattgaaaggtgatcacagtataaaatataaaaacacttgcctaaagcagttagaaatttcttcagattaagataaaacaaatcataaaatactttatatattagtacaagtatacataaaaatggcataaatggcataattgaaccaattactggattcaactatattaagactatttccttaaatcctacttcagactaaattattttacctacattcttttccatattttggaacttctgagtcattattttccatcttgcacattaaaataatttaaaattacatgtatcccttctcaataagtttaatcagctaaccctaagctagaggtcaaaatctacttcctctaatatcaaaacgaaaatttaaagttttccaaatattaattcaatattaattgaatattcaatgaattaattcatttaatgttagattaattcattgaatattaattcaatgaatgactaattaatagtattttaacaagattttggtatatttaacaacattttggtaataaagacaataatttgagagtgtgtggaagtccccctaatagaagccaactatctaatcaatgccaaaagtgtgaacaaaatagagaaaggaagcagtgaaaaagaatgcaactttttcttaccattcaaagtacaggatcacagcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtatttttaaagctattaacaagcaatatattaaaataataatgtattatatctgtttctgacccagtctatgtacaatattgctggtgagccctctcccttcagtgtgtcactgttcactttggagggttactttaggaagaggataagtgttaccacaggggaaaaaaatgcagaagaggatgcatcagaagaaatggcatgacaatgttttctcttagtgtcttttaaatactaggttagtgcgaaagtgatttctgccatttaaaaaccacaatcactttcgcactaatagctcctgaataagacctgtcagcatcctttagtctaaggtgatgagaaatccatgttaccgatatagaagccaaactctaagccaagatcacataaagagaagaaaaagtacaacttctgataattcctctttgagaggcatgacagcagagctcagggatcttcttgcatttctacagaagatgcactggctgccctgggtttgtatctttcacaacaaagagtcttttccaagcacagaccagaggtcaggagaggactgtcaatccagtttgcactgaaataggcattagctgcctctaaattataaattatctcagccatcccttgtccttaggattagtaattaatgaaatgctaagagaactgatgaaaagatacaactgtttcttaaaaagattcagacaaatttattatgggtttacttttcctaattaataaagacttttacatcatagaaagcattaccttccttaggtttcacaattggtttttccttaggtggaataaatgctttgtttctttcctcttgtctcttactgatggcttctgcttgtttagcctacattaataaataaaaaatatatcagttaaatgtatttatagttaaataattcaagtatctatgaactttgctattcatgtgagccagacataaagtgccgtacctttattgcttccattttctgccgcttcttctgatttgccttcaaaaagtattcaccactagccaattctttatcgatctgttgaaaacggtatttacaattacatcagaaataatgtagaggagaagtcatgtcctaagcaagtcacaatatccttagggtaaaaacaatggggtcaaactgatttattaataaaaatggtagtgacataaaggaaacagagtctaagctgaggggaatacatacacaaaagtgtggaggtaggaaagcacctccatggaatacaacccagagtagttcagggatatggcatggaaggtcactgattcagaaaagtgtgagaagaaactggagagagagttttggggaaaatttgaagaagcttcaatggcagacaaagtaggagggataagatttagaaatgactgtaggtttctgagaagactgtaaagaccaaagaataattttaatggagaggaatgaagaatagatgagagcctggaataaaggtagtggcatgcagaataaaagccagaactatcaggaattggtgactaattagcaaaagcaacagcttgttcattcaatatacagccaacatgtaaaatgtgtataactgacctgtctcccacttacatagcattattatatctaaggcactgttctaagctctttataattactcatttaatcctcactaacaattctttaagataggtattaccattactcccactttaggtatggggaaacttaagtatggatgggataaataactcgcccagtcacataatgaattaagtgttaagaacaagtcaatcgagacatcactgtttcaagaagcttacacagctacagaagaaagataagtcaattactacaagaaagggccataagaaataaggcaggtgttatggaagcatggtttaatgactgcatcactccactttccccctaactactatcaatttcctccatgatccaaaacttccattgttttttcactatgatcatcattttccccgtcaatcacaaatcttccctgaaagactccaaccatggttgtggaaaaaagagatgtagaaagcaatgagttcacatgctgagcagaagtagaaagggaaggctttaggatatagccaaggaagggaataatgaagcaagaacccccaggagacaggtgaagatggaattcaaagaacacatagaagaggctgatgcaggtggaagaaaacccatacgtgagagaagaggaaacagaaaggggttcttatctggtggtctcaaatatttcaataaaatgcaatgtcatatgctaaacatgggagggcactgagagaattaagaggaaacatgaattttgaatgaaattaatccaaagataaaactttctctaacttaatttggtagccacgttgcaaggaagaagtcaagtttttagactgatccaagttttagagctttgctgagaaggtgggacagaagtaaaaaggggcatgaatcaaaacaatgatgtgcaagaacaaaatggaaactggtcatggtgggaaaggaaatgaagcagaagacacctgacaaaaggaatcataacttagaaaaacggtgggtgttacaatttacaatttaagatttcagaacaagaacaaccatagagcacacagtcacaataatgttgccaaatcagagaaaagagtattgcagactaaacgaacttttatccatggaacatttacagtggctacagggtcacaaacctcctggatgcagtttataatcaatgtgaacgccccactgcacacccccatgcactcagctcaaaatatgcctatttatatttaccctcagtttcttatagctctgcacacacacacacaatatatatatatacacatatcccacctgaaatactttcaataaagtttctgaccaaa

SEQ ID NO: 8526 - DNA, 1234 bp, Homo sapiens
  ENST00000536703
ttctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcagagggaattacccaacttggccatataagagaggagccacctgcagtgcctgccccaataatgacaagtgtttggacaatctctgtgttaaccgacagcgagaccaagtcaaacgtacgtacatcaatcttaaattgtttcattaagagctatgtgaattctgtcagtgcattatgaggaacaatgtctaagaggatattctatgtttgtttcacaggttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtag

SEQ ID NO: 8527 - DNA, 714 bp, Homo sapiens
  ENST00000456650
atgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggtgtcacaggaaaggggtcgggatccaaaccccaagagagggttcttgaatctcgcgcgagaaaatccagggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtca

SEQ ID NO: 8528 - DNA, 667 bp, Homo sapiens
  ENST00000550491
atccagtttagctctgtctacccaactgttgttataagcaagtgccacagcacattttacttctctttggacacttcctgttttctggttttcagtggattttacttctctttttgttatcttcctccctgttaatttttgtgatttggttttctttttttttttttttttttgtctctaaatttactttttttgctgctgacaaagtactgagttgctcagacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtg

SEQ ID NO: 8529 - DNA, 812 bp, Homo sapiens
  ENST00000377959
cgcagccgcggggagcgaggagcgcgcggagccggccatgggcaagtcagcttccaaacagtttcataatgaggtcctgaaggcccacaatgagtaccggcagaagcacggcgtccccccactgaagctctgcaagaacctcaaccgggaggctcaacagtattctgaggccctggccagcacgaggatcctcaagcacagcccggagtccagccgtggccagtgtggggagaaccttgcatgggcatcctatgatcagacaggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtga

SEQ ID NO: 8530 - DNA, 1890 bp, Homo sapiens
  ENST00000377960
agccgcggggagcgaggagcgcgcggagccggccatgggcaagtcagcttccaaacagtttcataatgaggtcctgaaggcccacaatgagtaccggcagaagcacggcgtccccccactgaagctctgcaagaacctcaaccgggaggctcaacagtattctgaggccctggccagcacgaggatcctcaagcacagcccggagtccagccgtggccagtgtggggagaaccttgcatgggcatcctatgatcagacaggaaaggaggtggctgatagatggtacagtgaaatcaagaactataacttccagcagcctggcttcacctcggggactggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaataacctc

SEQ ID NO: 8531 - DNA, 2702 bp, Homo sapiens
  ENST00000474050
ctttttgtttatcatggtaaaaatgcatagcataaaatgtattatcttaaccatttttaagtgtacagttctgtagtgttaagtatatttacattgctatgcaacagagctccacaactttttcatgttgcaaaactgaaactctatacatgttaaacaacacctctgccttttctcctctccactgtagacctgaaatctttgtttttcctattgacaagggcttggtccgtctgttggccaggaagtcccgatacttcaggttgtagctccgccctctgccttaatgcctgtccccatgatcagtttccacctccatgtctccccacctctgcctgtcaaccaaaacctcacaaatcctggggttcagagcccccatatccctgccctgcccacattactctgactggacctcactggacagcctcactgagcccaagttctagagcttgcgccgcgtactctttgtctaagcgtctacttcctccttctcagaaggcccacggacagctccaccatgcaggtgtgacctgcagttaccttcaccttctgggtctgtagctcccgggtctgcagcccccaaaccccgcaaaggcaagccctgggtcttctttccctcacgtctcctcagaaattccatgggatttgacttggcccaggagacatgggagatctggctatgagaaaagggactaggactccctgttgcatcatctcctcagtctcgggtgaaaggcagcagagtagaagaaaggcaccagtgaagtttatttggctcacggttctggaggctgggaagtccaagagcatggcattggcatctggcgaggccctcatgctgcattatcccatggaagagcagaagggcaacttccaaacagtttcataatgaggtcctgaaggcccacaatgagtaccggcagaagcacggcgtccccccactgaagctctgcaagaacctcaaccgggaggctcaacagtattctgaggccctggccagcacgaggatcctcaagcacagcccggagtccagccgtggccagtgtggggagaaccttgcatgggcatcctatgatcagacaggaaaggaggtggctgatagatggtacagtgaaatcaagaactataacttccagcagcctggcttcacctcggggactggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgt

SEQ ID NO: 8532 - DNA, 1645 bp, Homo sapiens
  ENST00000619700
aagtcaggtgagcccgcgggctcgcccgctgcggaatggttcggaaccccgcgctcccggacctcgccgtctccctcgtccgccgcaagccaggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaataacctc

SEQ ID NO: 8533 - DNA, 1917 bp, Homo sapiens
  ENST00000396613
cggccgcatccggggagccctcggcagtcgcggagctgcttcccaggggtgagctctccgggaggcccacggggtggccccgggcgcctccgccctcagctgtcgctccttataaggcgggggccgggcggcgccggaggaggggccgcggcatcagcccggtcctgggctctggggcggcgctgggccgggcgagcgcagtgcagcgcagccgcggggagcgaggagcgcgcggagccggccatgggcaagtcagcttccaaacagtttcataatgaggtcctgaaggcccacaatgagtaccggcagaagcacggcgtccccccactgaagctctgcaagaacctcaaccgggaggctcaacagacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaataacctc

SEQ ID NO: 8534 - DNA, 2812 bp, Homo sapiens
  ENST00000312233
cactgtgtactgagactggatgcatccttgcaataaaaaagaggttgatcacgacaaatgtgaaccccgccgttataaaaacagccatcatggctgtaaatgccaaaaagcagtcagtcttgtaacttgaaaaaaaaaaaaaaggaattgtagattgtgcgcatggactcggagtgggggcggtggacagtaagtcatgatgttttggtggtaccacctggttgaatttcttcatctgaataagaagctcctgtgatgttctggggaggccttggaaggctagcgcatccctcatagaaagtgaatgggagctacggacaccgtaccccgggctcagagaagagcctgctggacctggaccttgctgagggccctggccccacctgctgccagggcctgtttctccctgcaggaagcccaccgccccgggctcacccccaagcttgtgagaggctgctgcatttcccccaccctgacaggtcacctagaccccaggccacgtatgtgaacggcagcctcccaaccacacaacacatcaaacaggagtccttgcccgactaccaagccatggcagaggcccgcacatccctgtctgcccactgtcggggcccgctggccactggcctgcacccagacctggacctcccgggccgaagcctcgccacccctgcgccttcctgctaccttctgggcagcgaacccagctctggcctgggcctccagcccgagacccacctccccgagggcagcctgaagcggtgctgcgtcttgggcctaccccccacctccccagcctcctcctcaccctgtgcctcctccgacgtcacctccatcatccgctcctcccagacgtctctggtcacctgtgtaaatggactccggagcccccctctgacgggagatctggggggcccttccaagcgggcccggcctggccctgcatcgacggacagccatgagggcagcttgcaacttgaagcctgccggaaggcgagcttcctgaagcaggaacccgcggatgagttttcagagctctttgggcctcaccagcagggcctgccgcccccctatcccctgtctcagttgccgcctggcccaagccttggaggcctggggctgggcctggcaggcagggtggtggccgggcggcaggcgtgccgctgggtggactgctgtgcagcctatgagcagcaggaggagctggtgcggcacatcgagaagagccacatcgaccagcgcaagggcgaggacttcacctgcttctgggctggctgcgtgcgccgctacaagcccttcaacgcccgctacaagctgctcatccacatgcgagtgcactcgggcgagaagcccaacaagtgcatgtttgaaggctgcagcaaggccttctcacggctggagaacctcaagatccacctgaggagccacacgggcgagaagccgtacctgtgccagcacccgggttgccagaaggccttcagcaactccagcgaccgcgccaagcaccagcgcacccacctagacacgaagccgtacgcctgtcagatccctggctgctccaagcgctacacagaccccagctccctccgcaagcacgtcaaggcccattcagccaaagagcagcaggtgcgtaagaagctgcatgcgggccctgacaccgaggccgacgtcctgaccgagtgtctggtcctgcagcagctccacacgtccacacagctggctgccagcgacggcaagggtggctgtggcctgggccaggagctgctcccaggtgtgtatcctggctccatcaccccccataacggacttgcatcgggcctcctgcccccagcgcacgacgtaccttccaggcaccacccgctggatgccaccaccagttcccaccaccatctgtcccctctgcccatggctgagagcacccgggatgggttggggcccggcctcctctcaccaatagtcagccccctgaaggggctggggccaccgccgctgcccccatcctctcagagccattctccggggggccagcccttccccacactccccagcaagccgtcctacccacccttccagagccctccacccccgcctctgcccagcccacaaggttaccagggcagtttccactccatccagagttgcttcccctatggcgactgctaccggatggctgaaccagcagccggtggggacggactggtcggggagacccacggtttcaaccccctgcggcccaatggctaccacagcctcagcacgcccttgcctgccacaggctatgaggccctggctgaggcctcatgccccacagcgctgccacagcagccatctgaagatgtggtgtccagcggccccgaggactgtggcttcttccccaatggagcctttgaccactgcctgggccacatcccctccatctacacagacacctgaaggagcccccacatgcgcctgcccatccagcactgcagatgccacctcgcccacctgctgtcgctcccaccctccgtgcacctagcaggagtgccaggccacagccggaacagccaggccatgacccaggggagccagcgctgccaccccacccagcgctgccagggagccgccatccgagcttgagctgggcgcacagaggtgcccgccaggatctgtggccctgtaacattccctcgatcttgtcttcccgttcctccccgcagtggttttgaaatcacagacctcgtgtatataaaatatgcagaacttgttttccgttcccctgccagttttatatttttggttttacaagaaaaaacattaaaaactggaaaggaga

SEQ ID NO: 8535 - DNA, 2807 bp, Homo sapiens
  ENST00000628545
gagcccggcgcgacccccagccgtgcgccccgccccggcgccatgcattgcgaggtggctgaggcacactcggacaagaggcctaaggaggcccctggtgcgcccggccccgaccgcggccccgccagcctcggcgcgcacatggccttcagggtcaccgtgagtggcggcggctgcggggacaggggcccgcgggacctgctagcccggccgcctgcgccgccaccgcgcgcccacgacctcctccggccccgcagtccccgagactacggtccatccaaggccgccgccgccgggaaggtgaatgggagctacggacaccgtaccccgggctcagagaagagcctgctggacctggaccttgctgagggccctggccccacctgctgccagggcctgtttctccctgcaggaagcccaccgccccgggctcacccccaagcttgtgagaggctgctgcatttcccccaccctgacaggtcacctagaccccaggccacgtatgtgaacggcagcctcccaaccacacaacacatcaaacaggagtccttgcccgactaccaagccatggcagaggcccgcacatccctgtctgcccactgtcggggcccgctggccactggcctgcacccagacctggacctcccgggccgaagcctcgccacccctgcgccttcctgctaccttctgggcagcgaacccagctctggcctgggcctccagcccgagacccacctccccgagggcagcctgaagcggtgctgcgtcttgggcctaccccccacctccccagcctcctcctcaccctgtgcctcctccgacgtcacctccatcatccgctcctcccagacgtctctggtcacctgtgtaaatggactccggagcccccctctgacgggagatctggggggcccttccaagcgggcccggcctggccctgcatcgacggacagccatgagggcagcttgcaacttgaagcctgccggaaggcgagcttcctgaagcaggaacccgcggatgagttttcagagctctttgggcctcaccagcagggcctgccgcccccctatcccctgtctcagttgccgcctggcccaagccttggaggcctggggctgggcctggcaggcagggtggtggccgggcggcaggcgtgccgctgggtggactgctgtgcagcctatgagcagcaggaggagctggtgcggcacatcgagaagagccacatcgaccagcgcaagggcgaggacttcacctgcttctgggctggctgcgtgcgccgctacaagcccttcaacgcccgctacaagctgctcatccacatgcgagtgcactcgggcgagaagcccaacaagtgcatgtttgaaggctgcagcaaggccttctcacggctggagaacctcaagatccacctgaggagccacacgggcgagaagccgtacctgtgccagcacccgggttgccagaaggccttcagcaactccagcgaccgcgccaagcaccagcgcacccacctagacacgaagccgtacgcctgtcagatccctggctgctccaagcgctacacagaccccagctccctccgcaagcacgtcaaggcccattcagccaaagagcagcaggtgcgtaagaagctgcatgcgggccctgacaccgaggccgacgtcctgaccgagtgtctggtcctgcagcagctccacacgtccacacagctggctgccagcgacggcaagggtggctgtggcctgggccaggagctgctcccaggtgtgtatcctggctccatcaccccccataacggacttgcatcgggcctcctgcccccagcgcacgacgtaccttccaggcaccacccgctggatgccaccaccagttcccaccaccatctgtcccctctgcccatggctgagagcacccgggatgggttggggcccggcctcctctcaccaatagtcagccccctgaaggggctggggccaccgccgctgcccccatcctctcagagccattctccggggggccagcccttccccacactccccagcaagccgtcctacccacccttccagagccctccacccccgcctctgcccagcccacaaggttaccagggcagtttccactccatccagagttgcttcccctatggcgactgctaccggatggctgaaccagcagccggtggggacggactggtcggggagacccacggtttcaaccccctgcggcccaatggctaccacagcctcagcacgcccttgcctgccacaggctatgaggccctggctgaggcctcatgccccacagcgctgccacagcagccatctgaagatgtggtgtccagcggccccgaggactgtggcttcttccccaatggagcctttgaccactgcctgggccacatcccctccatctacacagacacctgaaggagcccccacatgcgcctgcccatccagcactgcagatgccacctcgcccacctgctgtcgctcccaccctccgtgcacctagcaggagtgccaggccacagccggaacagccaggccatgacccaggggagccagcgctgccaccccacccagcgctgccagggagccgccatccgagcttgagctgggcgcacagaggtgcccgccaggatctgtggccctgtaacattccctcgatcttgtcttcccgttcctccccgcagtggttttgaaatcacagacctcgtgtatataaaatatgcagaacttgttttccgttcccctgccagttttatatttttggttttacaagaaaaaacattaaaaactggaaa

SEQ ID NO: 8536 - DNA, 6667 bp, Homo sapiens
  ENST00000324333
atcctttatggttgaagggtgttggaggaagcagagttttcatcagctgctgaagtggcaactaatagaggtttgaatggccgtagaaaaatattgtgttacttgtttgttgtctaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatggccttgatctaggggatctccttagccttcctcccgggacatccatgtccagcaatagtgtctctaactcattaccatcctacctttttggcacggaaagtagccactctccttaccctagtcctcggcactcatccaccaggtcccactcggcccgctccaagaagagagcgctgtccttgtccccgctgtccgatggcatcgggatagatttcaataccatcatccgcacgtcgcccacgtccttggtggcctacatcaacgggtcgagggcttcgccggccaacctgtccccgcagccggaggtctacgggcatttcctgggcgtgcgcggcagctgcattccccagccgcgcccggtgcccggcagccagaagggcgtgctggtggcccctggaggcctggcgctgccggcctacggcgaggacggggccctggagcacgagcgcatgcaacagctggagcacggcggcctgcagccaggcctggtcaaccacatggtggtgcagcatggcctgccgggccccgacagccagtcggccggcctgttcaagaccgaacgcctggaggagttcccgggcagcaccgtagacctaccccccgcgcctccgctccctcctctgccgccgcccccaggccccccacccccttaccatgcccatgcgcaccttcaccacccggagctcgggccccacgcccagcagctggccttgccccaggccaccctggacgacgacggggagatggacggcatcgggggcaagcattgctgccgctggatcgactgcagcgccctgtacgaccagcaggaggagctcgtgcggcacatcgagaaggtccacatcgaccagcgcaaaggggaggacttcacttgcttctgggccggttgccctcgaagatacaagcccttcaacgcccgctataaactgctgatccacatgagagtccactctggggagaagcccaacaagtgtacgtttgaaggttgcgagaaggccttttcaaggcttgaaaatctcaagatccacttgcggagccacacaggcgagaagccgtatttgtgccagcatccgggttgtcagaaggccttcagtaactccagtgaccgcgccaaacaccagcggacgcatctggacaccaaaccttatgcttgtcaaattccaggatgtaccaaacgctacacagacccaagttccctaagaaagcatgtgaaggcacattcttccaaagagcaacaagcaaggaaaaagttgcggtccagcacagagctccatccagacctgctcacagattgcctcaccgtgcagtccctgcagccggccacttcccctagagatgctgctgctgaagggaccgtgggacgctcccctggacccgggcctgacctctattcagctcccattttctccagcaattattcaagccgaagtggaacagctgctggggccgtaccacccccacatcctgtcagtcacccttctccaggacataatgtacaggggagccctcacaacccctcctcccagttacctccactcacagctgtggacgcaggagctgagaggtttgcaccttctgctccatctcctcaccacatcagcccccggagagttccagctccttcttcaatactgcaaagaacacagcctccctatacccagcagccatcaggttcacacctgaagtcctatcagccagaaacaaactcttcttttcaaccaaatggtatccatgtccatggattttatgggcagctgcagaagttctgtcccccacactaccccgattcccagagaattgtgccgcctgtcagctcctgcagtgtggtgccttcgtttgaggactgcctagtccctacatccatgggccaggccagttttgatgttttccacagagccttctcgactcactcgggcattacagtgtatgatttaccttcaagttcctcgagcctctttggggagtctctccgcagcggggctgaagatgctaccttcttgcagatcagcaccgtggaccgctgtcctagccagctctcctctgtctacaccgaaggctaaaagctctcttggccactcctgcacacccaggaccttgatgttgcttgccaccttttgttttcgtactctcacagactgcttgaggaaggatgtcagcccaatcagcgggccctgcagagttactgatgttctttcagaaggcaggactgaatggcagagctagctttgcaggaatcattacagttgctcctttttctctctggttttcctggactatgtgaccaggaggactgtcttttcaaagggaatttagagcctcactctcctggatacctgttacttcctggctgtcaacccttaaaggaccccagtgaaatgatgtgcatatgaaaatgtagtttggggatgactctacctgaaaactccaaacagggaaaaagacctcaattacgagaggcatagtgacctgcctcacctaatcctcacccttgctgctcctgatgcaaagccaggcacaacaagggaaatccatgtccaaagcatagtgtggtctcaactcttagaaactccctgggtttcccttttctcttagccacatgctaaccagttgcttctcagtgtttctcttcaatagaaaaataaggttttatatgccagcagcctatccttgtttttgcattttaaagacttagttatttatacgtattttaaaatgaaaaaaaaatgtaaaggtctgtgctttggatggaaatcattattattgtaatcaccccagctatagacattttgcacagctgtggttctgcctggccccacctctagcatgttagttttgcagttagcaaaggttacctgagggaaatggagtgggcacctcccgcaccaacagtcctgtagctggaaccttcctgagttgactgtttagtaactccacctcaaagactgtgttcaaagaaaaatgttgtttgactggtttacccattgcctccactctggtgctgcacccagagaagtgccagatgtgagaactgggacagactgagtcatgtgccagcttcccttggaaaaccaaacctagtgatacttgacttccagtgctcagattttactaacgtttttcaggatatccactcatctgtctgtctcttccctacacttctctccaccctctttttgcatccctcttaccctcttcctgactgtggttcatatatccccaccagccgccattgtctgatcatcttgggaaggtagaggtgacagttctcgaaaagtctacagaaagaggcaattctttttctgagttccagtttgaaggcctggaattttcacatagcacttggtcgaaaatatcaagcctaaataggaagtcattttctgtgacacctctacatagctattacagatcctaagtcctagggcatcagctataaaaattggccagtcccaaagacacagtaagttctaacattctggtactatcatatttcaagtattttttctcactttttaaaaatgtttttctgaacaaaagtgaaacaatgccatttatcaaactgagatcattacaatcttcaacaagacaactaaaacagcttgatgttagatgggattctgtgacagtttgtatactgacaggtccttccagtctccctccacagtcccacaagcggaagtattctacctgattccagagttcattccaacatgcagtagaatgaggtgaatgaagaaccaagtgtgggttttgttttcacagtgcacttggtcaatctagtttctctgagtagtgggctgtattctaagaaaagctttcacgtagacgtcaaagtctgcaaaagagatgagttagccactttaaaaaacctgctctgctttacaaaagatgcacaccaggcttcctttacaagtgaactccaaggctgcttgtaaagtaccacccttcctgcagactttgtgggtcgtgtcacttggcctaaacaagtggcctaacatatgcatgctcacagctagtagcatccctcatgcgtcctttgtcatactctggaaagaaaaaaactctgctatcttcagagaaaccatctattcatacttaaatatggaagcctttacaaggaactcaaaatacatttcatttcatttgtacaatgagaaaaaagatgaaaaggcaaggttgttattgcagttgacattgtcagccctgccttttggctttatgtaatttaaaatagaaagggggaaggaggacaagacagaagctcaactttagaaaccatggacatcacctccctctttgagaggagctgcttgtgaaccaggctccagtcttcctgtggcctctcacagtaaccctgcccctttcttacctcacaggggcaagagggactctaaagagggcgtaagcaatagaggcacctgcagccctccttcctcagcaggaaatcaatgtggagccccagagggacattttatctcagagagagcatgctggccacaggacccagtgcagccctgcttcccgcaccgtgggtctttcctgatagctgcaggcttgagattgcagcctcaggataggacacgttcagatgccttccagactacacacactatgcttagattcgagagtctttcctgaccttaaaatttgtcccttgcttactttcacactgcagaagatttatatatatattcatcattatttttgcagcagtacaagtggaaacttcaaaaaaatcattccctttcatgtcctggtctttttaagtcttgatatgtaaccattttcataaatgtccaaacagagattgtcattccccttaaaaacagaaacaaaacacaaaactagtgcttgtgaaaacacacagcgcaaagacaattatcctattgcattaaaaaaaaaatcagtctgcctagagacatttcattggctgcattgtcttaattccctaacgaaactgcatcaaaatgtcagttgtaatttagcctctgatcagctgttaaatattatttaaatatttacaggtcctgtggggtatctcccattacccatgtcgccctcaaattacataagcgatcataaaataagaagaaaaaaaaaggtctttagtagatcacagcagagttaccactgataagagtgttggctttgttcagttgtttctaaattaccagccgtcaagcacagtagcccctaaaaccaattttgagcaaggataaattcaactccctcatctgagaaccttgactttccagttgccttgaagtattgggaatagtaactgtacattttcaatttaattatttggtattttatttgactgtcttggccatgtcattttatggaagcatttttaaatagcactttttgttagtggtgtggaatttctgcggttattatttttttttttttttgcaacagatgaagcaaaaaaaaaaaagcactcattggagaaatagtgagtgtaaaaagagatttattttgtacagacagcaaagtatcctgtgtaatgttgctgacataaagcactttgggggaaaaaagtggaaatctgttttccataaatcacacagactcttgtacatagttatatacactcacgtagagaaatgaactgcatatatcatactggatatggggccgattttactctagaggcacatctggtgcttattgtcataaatcttttaaagaattaggtacacttttttctattaatatgtatagttttgtgatttgtcacagttatgtttcatataatcataagttattttgtcttgttcatgaagtcctttttttatgtcaaaagtaaaatgaagggattgtgcacttggtacagaataaaactggaaatagagaagacgccctcctgcctaaaatcctccttcagcctgtcggtttaaaacacaatggcaaccatcattgtttgtttgtttgtttttttgttttgttttaccatcagcctcttacatactgggaatggtaattataattaaaggcagatgatgcgggagggaatgttcaagtccagctttaaaatgctgcattgctttgggccagagctgtagcctggatttaattatagatatgaggaggaaatggcagtaaaaatgaatgtctccctgagtcctttacatgttgggagtgtccataaataaaacatgaagttttatttcatcagatttaattaaagcttttatacatgttt

SEQ ID NO: 8537 - DNA, 4166 bp, Homo sapiens
  ENST00000461870
gtctccatcagccaagaagatttcatagggctagactcaccaaggtttgtgttacaaaaatgaaagtttgaaggttgcgagaaggccttttcaaggcttgaaaatctcaagatccacttgcggagccacacaggcgagaagccgtatttgtgccagcatccgggttgtcagaaggccttcagtaactccagtgaccgcgccaaacaccagcggacgcatctggacaccaaaccttatgcttgtcaaattccaggatgtaccaaacgctacacagacccaagttccctaagaaagcatgtgaaggcacattcttccaaagagcaacaagcaaggaaaaagttgcggtccagcacagagctccatccagacctgctcacagattgcctcaccgtgcagtccctgcagccggccacttcccctagagatgctgctgctgaagggaccgtgggacgctcccctggacccgggcctgacctctattcagctcccattttctccagcaattattcaagccgaagtggaacagctgctggggccgtaccacccccacatcctgtcagtcacccttctccaggacataatgtacaggggagccctcacaacccctcctcccagttacctccactcacagctgtggacgcaggagctgagaggtttgcaccttctgctccatctcctcaccacatcagcccccggagagttccagctccttcttcaatactgcaaagaacacagcctccctatacccagcagccatcaggttcacacctgaagtcctatcagccagaaacaaactcttcttttcaaccaaatggtatccatgtccatggattttatgggcagctgcagaagttctgtcccccacactaccccgattcccagagaattgtgccgcctgtcagctcctgcagtgtggtgccttcgtttgaggactgcctagtccctacatccatgggccaggccagttttgatgttttccacagagccttctcgactcactcgggcattacagtgtatgatttaccttcaagttcctcgagcctctttggggagtctctccgcagcggggctgaagatgctaccttcttgcagatcagcaccgtggaccgctgtcctagccagctctcctctgtctacaccgaaggctaaaagctctcttggccactcctgcacacccaggaccttgatgttgcttgccaccttttgttttcgtactctcacagactgcttgaggaaggatgtcagcccaatcagcgggccctgcagagttactgatgttctttcagaaggcaggactgaatggcagagctagctttgcaggaatcattacagttgctcctttttctctctggttttcctggactatgtgaccaggaggactgtcttttcaaagggaatttagagcctcactctcctggatacctgttacttcctggctgtcaacccttaaaggaccccagtgaaatgatgtgcatatgaaaatgtagtttggggatgactctacctgaaaactccaaacagggaaaaagacctcaattacgagaggcatagtgacctgcctcacctaatcctcacccttgctgctcctgatgcaaagccaggcacaacaagggaaatccatgtccaaagcatagtgtggtctcaactcttagaaactccctgggtttcccttttctcttagccacatgctaaccagttgcttctcagtgtttctcttcaatagaaaaataaggttttatatgccagcagcctatccttgtttttgcattttaaagacttagttatttatacgtattttaaaatgaaaaaaaaatgtaaaggtctgtgctttggatggaaatcattattattgtaatcaccccagctatagacattttgcacagctgtggttctgcctggccccacctctagcatgttagttttgcagttagcaaaggttacctgagggaaatggagtgggcacctcccgcaccaacagtcctgtagctggaaccttcctgagttgactgtttagtaactccacctcaaagactgtgttcaaagaaaaatgttgtttgactggtttacccattgcctccactctggtgctgcacccagagaagtgccagatgtgagaactgggacagactgagtcatgtgccagcttcccttggaaaaccaaacctagtgatacttgacttccagtgctcagattttactaacgtttttcaggatatccactcatctgtctgtctcttccctacacttctctccaccctctttttgcatccctcttaccctcttcctgactgtggttcatatatccccaccagccgccattgtctgatcatcttgggaaggtagaggtgacagttctcgaaaagtctacagaaagaggcaattctttttctgagttccagtttgaaggcctggaattttcacatagcacttggtcgaaaatatcaagcctaaataggaagtcattttctgtgacacctctacatagctattacagatcctaagtcctagggcatcagctataaaaattggccagtcccaaagacacagtaagttctaacattctggtactatcatatttcaagtattttttctcactttttaaaaatgtttttctgaacaaaagtgaaacaatgccatttatcaaactgagatcattacaatcttcaacaagacaactaaaacagcttgatgttagatgggattctgtgacagtttgtatactgacaggtccttccagtctccctccacagtcccacaagcggaagtattctacctgattccagagttcattccaacatgcagtagaatgaggtgaatgaagaaccaagtgtgggttttgttttcacagtgcacttggtcaatctagtttctctgagtagtgggctgtattctaagaaaagctttcacgtagacgtcaaagtctgcaaaagagatgagttagccactttaaaaaacctgctctgctttacaaaagatgcacaccaggcttcctttacaagtgaactccaaggctgcttgtaaagtaccacccttcctgcagactttgtgggtcgtgtcacttggcctaaacaagtggcctaacatatgcatgctcacagctagtagcatccctcatgcgtcctttgtcatactctggaaagaaaaaaactctgctatcttcagagaaaccatctattcatacttaaatatggaagcctttacaaggaactcaaaatacatttcatttcatttgtacaatgagaaaaaagatgaaaaggcaaggttgttattgcagttgacattgtcagccctgccttttggctttatgtaatttaaaatagaaagggggaaggaggacaagacagaagctcaactttagaaaccatggacatcacctccctctttgagaggagctgcttgtgaaccaggctccagtcttcctgtggcctctcacagtaaccctgcccctttcttacctcacaggggcaagagggactctaaagagggcgtaagcaatagaggcacctgcagccctccttcctcagcaggaaatcaatgtggagccccagagggacattttatctcagagagagcatgctggccacaggacccagtgcagccctgcttcccgcaccgtgggtctttcctgatagctgcaggcttgagattgcagcctcaggataggacacgttcagatgccttccagactacacacactatgcttagattcgagagtctttcctgaccttaaaatttgtcccttgcttactttcacactgcagaagatttatatatatattcatcattatttttgcagcagtacaagtggaaacttcaaaaaaatcattccctttcatgtcctggtctttttaagtcttgatatgtaaccattttcataaatgtccaaacagagattgtcattccccttaaaaacagaaacaaaacacaaaactagtgcttgtgaaaacacacagcgcaaagacaattatcctattgcattaaaaaaaaaatcagtctgcctagagacatttcattggctgcattgtcttaattccctaacgaaactgcatcaaaatgtcagttgtaatttagcctctgatcagctgttaaatattatttaaatatttacaggtcctgtggggtatctcccattacccatgtcgccctcaaattacataagcgatcat

SEQ ID NO: 8538 - DNA, 3961 bp, Homo sapiens
  ENST00000381971
cgggaccccctgtacgccgtccgcgccgtccagggtcacaccggcgacggaacccgccggcagcaattagccagcatcccggggtcggcccccagaagcattccccggcccaggacgaggatgaacaggacaggcgaggcacaaagtcgcaactgaactttttagaaacattatttgtgtgtgtatgtgtgtagcaggggagaatgagctgatgccgagggtccagccaccccgcctctgcctcctcctccccctgccgccgctgccctcgcagacgcgcgcgcacacacggcacttgggccgggtttccgcgctccgtccccccgtttggatgggggttttcatttccgaaggaggcacagcccgcggagcgctctgaagggctggagccccaagttactcctcgccagcgccggccgcccgctgtcactcgcgctggccggccgggggaagggacccgcacgccgggctttgttgtggaaatcccggttacctggcttataacccacaccatggataacttattggactttgcctgaaaggagtcattagtgacattggatatttgaccgtcttggccacaggtttttcagaatgaatggaagatcatgcagcatgagtctccaccggacatcgggaaccccacaggggcctaggatggtcagtggtcatcacattcctgccatccgagcccactccgggactcctggcccctcgccctgtggcagcacatcgagtcccactatggcaagccttgctaacaacctccatctcaagatgccctcaggaggagggatggctcctcagaacaacgtggctgagagccgcatccatctgcctgccttaagccccaggagacaaatgctcaccaatgggaagccgcgattccaggtcacccaggctggaggcatgtcagggtcacatactttaaagccaaagcagcaggagtttggaagcccttttcctccaaatcctgggaaaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatggccttgatctaggggatctccttagccttcctcccgggacatccatgtccagcaatagtgtctctaactcattaccatcctacctttttggcacggaaagtagccactctccttaccctagtcctcggcactcatccaccaggtcccactcggcccgctccaagaagagagcgctgtccttgtccccgctgtccgatggcatcgggatagatttcaataccatcatccgcacgtcgcccacgtccttggtggcctacatcaacgggtcgagggcttcgccggccaacctgtccccgcagccggaggtctacgggcatttcctgggcgtgcgcggcagctgcattccccagccgcgcccggtgcccggcagccagaagggcgtgctggtggcccctggaggcctggcgctgccggcctacggcgaggacggggccctggagcacgagcgcatgcaacagctggagcacggcggcctgcagccaggcctggtcaaccacatggtggtgcagcatggcctgccgggccccgacagccagtcggccggcctgttcaagaccgaacgcctggaggagttcccgggcagcaccgtagacctaccccccgcgcctccgctccctcctctgccgccgcccccaggccccccacccccttaccatgcccatgcgcaccttcaccacccggagctcgggccccacgcccagcagctggccttgccccaggccaccctggacgacgacggggagatggacggcatcgggggcaagcattgctgccgctggatcgactgcagcgccctgtacgaccagcaggaggagctcgtgcggcacatcgagaaggtccacatcgaccagcgcaaaggggaggacttcacttgcttctgggccggttgccctcgaagatacaagcccttcaacgcccgctataaactgctgatccacatgagagtccactctggggagaagcccaacaagtgtacgtttgaaggttgcgagaaggccttttcaaggcttgaaaatctcaagatccacttgcggagccacacaggcgagaagccgtatttgtgccagcatccgggttgtcagaaggccttcagtaactccagtgaccgcgccaaacaccagcggacgcatctggacaccaaaccttatgcttgtcaaattccaggatgtaccaaacgctacacagacccaagttccctaagaaagcatgtgaaggcacattcttccaaagagcaacaagcaaggaaaaagttgcggtccagcacagagctccatccagacctgctcacagattgcctcaccgtgcagtccctgcagccggccacttcccctagagatgctgctgctgaagggaccgtgggacgctcccctggacccgggcctgacctctattcagctcccattttctccagcaattattcaagccgaagtggaacagctgctggggccgtaccacccccacatcctgtcagtcacccttctccaggacataatgtacaggggagccctcacaacccctcctcccagttacctccactcacagctgtggacgcaggagctgagaggtttgcaccttctgctccatctcctcaccacatcagcccccggagagttccagctccttcttcaatactgcaaagaacacagcctccctatacccagcagccatcaggttcacacctgaagtcctatcagccagaaacaaactcttcttttcaaccaaatggtatccatgtccatggattttatgggcagctgcagaagttctgtcccccacactaccccgattcccagagaattgtgccgcctgtcagctcctgcagtgtggtgccttcgtttgaggactgcctagtccctacatccatgggccaggccagttttgatgttttccacagagccttctcgactcactcgggcattacagtgtatgatttaccttcaagttcctcgagcctctttggggagtctctccgcagcggggctgaagatgctaccttcttgcagatcagcaccgtggaccgctgtcctagccagctctcctctgtctacaccgaaggctaaaagctctcttggccactcctgcacacccaggaccttgatgttgcttgccaccttttgttttcgtactctcacagactgcttgaggaaggatgtcagcccaatcagcgggccctgcagagttactgatgttctttcagaaggcaggactgaatggcagagctagctttgcaggaatcattacagttgctcctttttctctctggttttcctggactatgtgaccaggaggactgtcttttcaaagggaatttagagcctcactctcctggatacctgttacttcctggctgtcaacccttaaaggaccccagtgaaatgatgtgcatatgaaaatgtagtttggggatgactctacctgaaaactccaaacagggaaaaagacctcaattacgagaggcatagtgacctgcctcacctaatcctcacccttgctgctcctgatgcaaagccaggcacaacaagggaaatccatgtccaaagcatagtgtggtctcaactcttagaaactccctgggtttcccttttctcttagccacatgctaaccagttgcttctcagtgtttctcttcaatag

SEQ ID NO: 8539 - DNA, 1585 bp, Homo sapiens
  ENST00000467497
ggacgacgacggggagatggacggcatcgggggcaagcattgctgccgctggatcgactgcagcgccctgtacgaccagcaggaggagctcgtgcggcacatcgagaaggtccacatcgaccagcgcaaaggggaggacttcacttgcttctgggccggttgccctcgaagatacaagcccttcaacgcccgctataaactgctgatccacatgagagtccactctggggagaagcccaacaagtgtacgtttgaaggttgcgagaaggccttttcaaggcttgaaaatctcaagatccacttgcggagccacacaggcgagaagccgtatttgtgccagcatccgggttgtcagaaggccttcagtaactccagtgaccgcgccaaacaccagcggacgcatctggacaccaaaccttatgcttgtcaaattccaggatgtaccaaacgctacacagacccaagttccctaagaaagcatgtgaaggcacattcttccaaagagcaacaagcaaggaaaaagttgcggtccagcacagagctccatccagacctgctcacagattgcctcaccgtgcagtccctgcagccggccacttcccctagagatgctgctgctgaagggaccgtgggacgctcccctggacccgggcctgacctctattcagctcccattttctccagcaattattcaagccgaagtggaacagctgctggggccgtaccacccccacatcctgtcagtcacccttctccaggacataatgtacaggggagccctcacaacccctcctcccagttacctccactcacagctgtggacgcaggagctgagaggtttgcaccttctgctccatctcctcaccacatcagcccccggagagttccagctccttcttcaatactgcaaagaacacagcctccctatacccagcagccatcaggttcacacctgaagtcctatcagccagaaacaaactcttcttttcaaccaaatggtatccatgtccatggtaagcaagaagctggcagtcccttgagttttgaaaagtgacattgtgctgttgcttttcatcttagttacctgtcgtggatttcagatgctctgttctacaccaggcttaggctttcatgacttgcctctaaaatttcacacttgataggcatgaaatcctatggtattttcctgactttggcctgatgatggtatgatttatgacacatcgcactggtcagctcaagttgctggttttttcattggccagggctctaacaccagcaatagcatcctgtttctaaacaatagacagcccatggagaaagaaatgacaggagttcttgtgcccaagcatgcctctgctctgctaggtttttgctctcattctcataggtccacatcctctccgtccttcaaggcgcaggtggaatgacacctcctctctgaagcccttcctgatcccccagctgatgtcatctctccaggctctaaactctgattttatatcgcctgtctttctctggtagtatttatgcttcctctaccttgtgttttacttatctgtgaataaaacatactttcactatt

SEQ ID NO: 8540 - DNA, 855 bp, Homo sapiens
  ENST00000463680
tttgaaggttgcgagaaggccttttcaaggcttgaaaatctcaagatccacttgcggagccacacaggcgagaagccgtatttgtgccagcatccgggttgtcagaaggccttcagtaactccagtgaccgcgccaaacaccagcggacgcatctggacaccaaaccttatgcttgtcaaattccaggatgtaccaaacgctacacagacccaagttccctaagaaagcatgtgaaggcacattcttccaaagagcaacaagcaaggaaaaagttgcggtccagcacagagctccatccagacctgctcacagattgcctcaccgtgcagtccctgcagccggccacttcccctagagatgctgctgctgaagggaccgtgggacgctcccctggacccgggcctgacctctattcaggtaaagacagcaaaggcagagccaaccacaactacccttttttaggccttttactctggttaaaaggaatgctcacgtgagaaaaattttcctaagatcgtctgtgttgttctttatcaatgggctgcaaattgctctccaccccttctgattcctgagctgggtgtggcagcagattgttttttctcataaagaaataaaataaaataatgcattacctcttttagttatggacttctgccagaaattcagtgtacccaaccctcgcagttatgttacatttactcacttgatttagactcgaaggaaatgtttcctccttaagcaggtagcaggctgcgtgtggatttcttaatgaaacagttgttgtcatctttatgttttaaaaggaagccccaggtctctaaggaaattttcacatcagcaaaccaacttat

SEQ ID NO: 8541 - DNA, 531 bp, Homo sapiens
  ENST00000464391
actacacagctggcagcctctgccattgcagtaagtatatgcgacagggtaaaaagggttaatgtggtgaggacaaaggactgcagaggcctggctaggagggtccagatgcttaataatactttgtatagaagtttgaaggttgcgagaaggccttttcaaggcttgaaaatctcaagatccacttgcggagccacacaggcgagaagccgtatttgtgccagcatccgggttgtcagaaggccttcagtaactccagtgaccgcgccaaacaccagcggacgcatctggacaccgtttcttctgaaaaatacccagtttttttctggactttctacagcttctttacctgaacccttaaagaatatgtgtttactagtttctgacagtaccaaagattattctcagggaaacataactaaaccttatgcttgtcaaattccaggatgtaccaaacgctacacagacccaagttccctaagaaagcatgtgaaggcacattcttccaaagagcaacaagcaaggaaaaag

SEQ ID NO: 8542 - DNA, 773 bp, Homo sapiens
  ENST00000469833
atctggtataggagcatgtaggaaagaaggattcattgtgacagagggatgtgggcaggcagcaggaggttccacctgagtgagccttgagtaaatggatagattttgactgcaagagtgaagacgggagcattccagtcccaggagatgaaggagcaatgttcttctatcagaagcaaacatattcagaaactccgtgtcctggctcgcttagcaataatagtacacatagcagtgtggtgaagtcaggcaccctcctgctactacaagagaatatgaagtaacgaagatcccccctgccacacacacatttgtgttttggtccccctcaccactcaccctctgaagaagaaggtcattctaagacaccaagtgacattcaggttctgaaggcaagattccatactctggggtgtgaggaattgtgctgttgaactcttcccccaagaagtgctcaggttgaggttaaagggctcctgagggcagaaaggcagatactgtcaaaaaagagagttcctgtgatcccggtgtcatgtggctccccaaacaatttcttgaagacttgtaaatgtggcagtctgcaaaagcagcagcagaagtgacaactgggaaaaattgtgataccgctttctgtgaatccccgaggacagccaacacgaccaaaggatccctgaaggtttgaaggttgcgagaaggccttttcaaggcttgaaaatctcaagatccacttgcggagccacacaggcgagaagccgtatttgtgccagcatccg

SEQ ID NO: 8543 - DNA, 768 bp, Homo sapiens
  ENST00000490709
ggggtcggcccccagaagcattccccggcccaggacgaggatgaacaggacaggcgaggcacaaagtcgcaactgaactttttagaaacattatttgtgtgtgtatgtgtgtagcaggggagaatgagctgatgccgagggtccagccaccccgcctctgcctcctcctccccctgccgccgctgccctcgcagacgcgcgcgcacacacggcacttgggccgggtttccgcgctccgtccccccgtttggatgggggttttcatttccgaaggaggcacagcccgcggagcgctctgaagggctggagccccaagttactcctcgccagcgccggccgcccgctgtcactcgcgctggccggccgggggaagggacccgcacgccgggctttgttgtggaaatcccggttacctggtcccttatttcgcgtgagtctttggcgtccacgaccttgagtctgacggaaagtcagtcggcctcaagcatgaagcaggagtggtcccagggctacagggccctcccttcgctctccaaccacggctctcagaatggccttgatctaggggatctccttagccttcctcccgggacatccatgtccagcaatagtgtctctaactcattaccatcctacctttttggcacggaaagtagccactctccttaccctagtcctcggcactcatccaccaggtcccactcggcccgctccaagaagagagcgctgtccttgtccccgctgtccgatggcatcgggatagatttc

SEQ ID NO: 8544 - DNA, 492 bp, Homo sapiens
  ENST00000473846
actgacctcatccatagtgtggtgtttggtctatgagcagttgattcaccagttttcagagcccaagtctaaaatcacagatcctgtgggggatctgggagcatctgccttacctttatgaaggttatggtcagttaagccttgctttcaatgggctcacttcgctatgggaagaaaattctgcagttgttaaaaacaaaaggacactgccttttccaagggagctgacagctattggtttttccggagaggattactggtgaagacagttatgaagaacaagtaactcttgtaaataaacagcatgttcttgcttaaatatttcccagaacagttctaaagaaatataatacaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 8545 - DNA, 700 bp, Homo sapiens
  ENST00000462164
actgacctcatccatagtgtggtgtttggtctatgagcagttgattcaccagttttcagagcccaagtctaaaatcacagatcctgtgggggatctgggagcatctgccttacctttatgaaggttatggtcagttaagccttgctttcaatgggctcacttcgctatgggaagaaaattctgcagttgttaaaaacaaaaggacactgccttttccaagggagctgacagctattggtttttccggagaggattactggtgaagacagttatgaagaacaagtaactcttgtaaataaacagcatgttcttgcttaaatatttcccagaacagttctaaagaaatataatacaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 8546 - DNA, 693 bp, Homo sapiens
  ENST00000478315
catttgtcagatgctttcctctctgcactccagcctttgctgaatgtcctggcagttcctgaatgttcctgctgcctgcattttataaaaccaaagagcaagtagccctggaaatgtatgccaagtactctgcacagctgtctgaggcccccagccaagggcaagatataaacaatctatacccacacaggtacacaagcagacactgcatatggaagccccgcagtgcaaggacttcttacttctaacactttaaaatgtcagtggccaaacagcctgagaacatgaataatttaagcatgagatgcttttgctgatgattttgatcatttttcaggaagaataatggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 8547 - DNA, 458 bp, Homo sapiens
  ENST00000478844
agttccaagttactcactggagctgacaagtcacctcggggaccgggaagtcactcaagtgtctggaaatcttggccctggctgatttgtcatcctatggatgattcaattaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 8548 - DNA, 944 bp, Homo sapiens
  ENST00000481827
agttccaagttactcactggagctgacaagtcacctcggggaccgggaagtcactcaagtgtctggaaatcttggccctggctgatttgtcatcctatggatgattcaattaggcttataacccacaccatggataacttattggactttgcctgaaaggagtcattagtgacattggatatttgaccgtcttggccacaggtttttcagaatgaatggaagatcatgcagcatgagtctccaccggacatcgggaaccccacaggggcctaggatggtcagtggtcatcacattcctgccatccgagcccactccgggactcctggcccctcgccctgtggcagcacatcgagtcccactatggcaagccttgctaacaacctccatctcaagatgccctcaggaggagggatggctcctcagaacaacgtggctgagagccgcatccatctgcctgccttaagccccaggagacaaatgctcaccaatgggaagccgcgattccaggtcacccaggctggaggcatgtcagggtcacatactttaaagccaaagcagcaggagtttggaagcccttttcctccaaatcctgggaaaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 8549 - DNA, 797 bp, Homo sapiens
  ENST00000491889
cccgtttggatgggggttttcatttccgaaggaggcacagcccgcggagcgctctgaagggctggagccccaagttactcctcgccagcgccggccgcccgctgtcactcgcgctggccggccgggggaagggacccgcacgccgggctttgttgtggaaatcccggttacctggcttataacccacaccatggataacttattggactttgcctgaaaggagtcattagtgacattggatatttgaccgtcttggccacaggtttttcagaatgaatggaagatcatgcagcatgagtctccaccggacatcgggaaccccacaggggcctaggatggtcagtggtcatcacattcctgccatccgagcccactccgggactcctggcccctcgccctgtggcagcacatcgagtcccactatggcaagccttgctaacaacctccatctcaagatgccctcaggaggagggatggctcctcagaacaacgtggctgagagccgcatccatctgcctgccttaagccccaggagacaaatgctcaccaatgggaagccgcgattccaggtcacccaggctggaggcatgtcagggtcacatactttaaagccaaagcagcaggagtttggaagcccttttcctccaaatcctgggaaaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 8550 - DNA, 1327 bp, Homo sapiens
  ENST00000477901
cgggaccccctgtacgccgtccgcgccgtccagggtcacaccggcgacggaacccgccggcagcaattagccagcatcccggggtcggcccccagaagcattccccggcccaggacgaggatgaacaggacaggcgaggcacaaagtcgcaactgaactttttagaaacattatttgtgtgtgtatgtgtgtagcaggggagaatgagctgatgccgagggtccagccaccccgcctctgcctcctcctccccctgccgccgctgccctcgcagacgcgcgcgcacacacggcacttgggccgggtttccgcgctccgtccccccgtttggatgggggttttcatttccgaaggaggcacagcccgcggagcgctctgaagggctggagccccaagttactcctcgccagcgccggccgcccgctgtcactcgcgctggccggccgggggaagggacccgcacgccgggctttgttgtggaaatcccggttacctggcttataacccacaccatggataacttattggactttgcctgaaaggagtcattagtgacattggatatttgaccgtcttggccacaggtttttcagaatgaatggaagatcatgcagcatgagtctccaccggacatcgggaaccccacaggggcctaggatggtcagtggtcatcacattcctgccatccgagcccactccgggactcctggcccctcgccctgtggcagcacatcgagtcccactatggcaagccttgctaacaacctccatctcaagatgccctcaggaggagggatggctcctcagaacaacgtggctgagagccgcatccatctgcctgccttaagccccaggagacaaatgctcaccaatgggaagccgcgattccaggtcacccaggctggaggcatgtcagggtcacatactttaaagccaaagcagcaggagtttggaagcccttttcctccaaatcctgggaaaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 8551 - DNA, 1481 bp, Homo sapiens
  ENST00000465708
cgggaccccctgtacgccgtccgcgccgtccagggtcacaccggcgacggaacccgccggcagcaattagccagcatcccggggtcggcccccagaagcattccccggcccaggacgaggatgaacaggacaggcgaggcacaaagtcgcaactgaactttttagaaacattatttgtgtgtgtatgtgtgtagcaggggagaatgagctgatgccgagggtccagccaccccgcctctgcctcctcctccccctgccgccgctgccctcgcagacgcgcgcgcacacacggcacttgggccgggtttccgcgctccgtccccccgtttggatgggggttttcatttccgaaggaggcacagcccgcggagcgctctgaagggctggagccccaagttactcctcgccagcgccggccgcccgctgtcactcgcgctggccggccgggggaagggacccgcacgccgggctttgttgtggaaatcccggttacctggcttataacccacaccatggataacttattggactttgcctgaaaggagtcattagtgacattggatatttgaccgtcttggccacaggtttttcagaatgaatggaagatcatgcagcatgagtctccaccggacatcgggaaccccacaggggcctaggatggtcagtggtcatcacattcctgccatccgagcccactccgggactcctggcccctcgccctgtggcagcacatcgagtcccactatggcaagccttgctaacaacctccatctcaagatgccctcaggaggagggatggctcctcagaacaacgtggctgagagccgcatccatctgcctgccttaagccccaggagacaaatgctcaccaatgggaagccgcgattccaggtcacccaggctggaggcatgtcagggtcacatactttaaagccaaagcagcaggagtttggaagcccttttcctccaaatcctgggaaaggtaggattgtctttctggaaccttttaaaaatggaaacgatttttttctcccccatcccattttctgccagcaaatcctatggaaaaatacatgattcagtgtcagggtcaaagatgatggtctcataatgatatatagcttgctcagtaagggaatgggtgtgtatgtgttggaggggaccacagtggtaaatgctgagtatgagacatctcctgggactgtgaaacagagtaacagtaagatagaaagataaaaaatagggaggcaggctgagtggttgtggtggaagggtaagagctaggttagcaagatcatgccctccggatacaggtagcgctgccctgtttccctgggggctgaattctccaggccatggacaagaagaccgactggaactgtccttatgccagtgctaaaagtatagtgtagaagaaaggtggtgtttggaaggaaaagaataaaaaagggaaattttaataaccaataaaatgaggaatc

SEQ ID NO: 8552 - DNA, 1569 bp, Homo sapiens
  ENST00000471664
ggaggtgatggctggagttccaacaggcacttggatcgtgagataacctcagaaagctgtttcccgagggtgctgaactggcaggaaagaaaccttggtcctcgatgatattgtgaagacaccatattagcatggatggcctatttctgaatttctttcaggcctgcttctctttaccttctgccatgagtggaagtggcctgaggccctcacctgaagccaagcagatgacagcaccaggcttcttgtatagcctgcagaaccgtttgcaaatgaaattcaaaaaatcggcagtgactcttcttggaccaggtggagagcaggaagaaggccggcagcaggtgtggctcgggcagattggagaggcacaatggggcacgtttgctagacaaatagagagacaggcacaaagagcttaagtgactaccctaaagttgctcagctattaaatgtggagccaggactaaatcccagcagtttggctctggggtctgggttctaaaattgtctcaattcagcctctccagctgccaagtgtgagacctagacaagggctttgagtttgactgtaggagccatcccaggcttataacccacaccatggataacttattggactttgcctgaaaggagtcattagtgacattggatatttgaccgtcttggccacaggtttttcagaatgaatggaagatcatgcagcatgagtctccaccggacatcgggaaccccacaggggcctaggatggtcagtggtcatcacattcctgccatccgagcccactccgggactcctggcccctcgccctgtggcagcacatcgagtcccactatggcaagccttgctaacaacctccatctcaagatgccctcaggaggagggatggctcctcagaacaacgtggctgagagccgcatccatctgcctgccttaagccccaggagacaaatgctcaccaatgggaagccgcgattccaggtcacccaggctggaggcatgtcagggtcacatactttaaagccaaagcagcaggagtttggaagcccttttcctccaaatcctgggaaaggtaggattgtctttctggaaccttttaaaaatggaaacgatttttttctcccccatcccattttctgccagcaaatcctatggaaaaatacatgattcagtgtcagggtcaaagatgatggtctcataatgatatatagcttgctcagtaagggaatgggtgtgtatgtgttggaggggaccacagtggtaaatgctgagtatgagacatctcctgggactgtgaaacagagtaacagtaagatagaaagataaaaaatagggaggcaggctgagtggttgtggtggaagggtaagagctaggttagcaagatcatgccctccggatacaggtagcgctgccctgtttccctgggggctgaattctccaggccatggacaagaagaccgactggaactgtccttatgccagtgctaaaagtatagtgtagaagaaaggtggtgtttggaaggaaaagaataaaaaagggaaattttaataaccaataaaatgaggaatc

SEQ ID NO: 8553 - DNA, 1882 bp, Homo sapiens
  ENST00000574745
tgctgccacaccagatccagaggcacagagccggggcacgttcctgtcaagggtgctggccctgccattctccccaggaggttacaggatccctccttgaggaaacgactcggaagtgggctcagtacaaacaggcatgtctgagagacttactcaaggaaccttctggcatattttgtaacgggacatttgatcagtacgtgtgttggcctcattcttctcctggaaatgtctctgtaccctgcccttcatacttaccttggtggagtgaagagagctcaggaagggcctacagacactgcttggctcaggggacttggcagacgatagagaacgccacggatatttggcaggatgactccgaatgctccgagaaccacagcttcaagcaaaacgtggatcgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggctgtggcccagatacctgctgttgggttgggccttccctgtgctatttgttgtaccctggggtttcgcccgtgcacacctggagaacacagggtgctggacaacaaatgggaataagaaaatctggtggatcatccgaggacccatgatgctctgtgtaacagtcaatttcttcatcttcctgaaaattctcaagcttctcatttctaagctcaaagctcatcaaatgtgcttcagagattataaatacagattggcaaaatcaacactggtcctcattcctttattgggcgttcatgagatcctcttctctttcatcactgatgatcaagttgaaggatttgcaaaacttatacgacttttcattcagttgacactgagctcctttcatgggttcctggtggccttgcagtatggttttgccaatggagaggtgaaggctgagctgcggaaatactgggtccgcttcttgctagcccgccactcaggctgcagagcctgtgtcctggggaaggacttccggttcctaggaaaatgtcccaagaagctctcggaaggagatggcgctgagaagcttcggaagctgcagccctcacttaacagtgggcggctcctacatctagccatgcgaggtcttggggagctgggcgcccagccccaacaggaccatgcacgctggccccggggcagcagcctgtccgagtgcagtgagggggatgtcaccatggccaacaccatggaggagattctggaagagagtgagatctagggtggagttccaccaccctggctctgctcccagggactcttgagggggcccaggaagaggaagcaaagcaggacacacgttgctgggcacggaatcattctcgttccattcaccatgccactttgatatgaaagctatcacaaggttcttcaagctctgtatgaaagaggctgtgtgtcatgctcacagcctctgcctgctcttctcatcctaataacccccaccagtgtgttttccacaatgcccaccagaccctagggcctggctctaaattcaagccaatgaagtcccaccatgaagagaggtctcctgttatagagaagccagcc

SEQ ID NO: 8554 - DNA, 4572 bp, Homo sapiens
  ENST00000262441
gaggagattttgcctttgtggttagcctcagcccagcctggacaagcttaatgccttagaaagaaataccctgcctcaaaaagacacctgcctctaaactggctcgagccccatcgccttctgccagccattcctctgtagctcgaaccccagcctgtctcagccagcttcgtgcattgagcagaaccttcagggtggagcccgctgaccgccttgttctttctcctcagcctgtcaaggaagtcccagaaagcacagctgacttagggaaggtctgggaaaaatctccctgcttttgggggggcaggggcgggggatgagccagggccgagaaggaactctgaagactccgtagattgctctagaccgcctcagacactctcggcgcagcgtggagaggatttgtgcaaacatttcctctgtggaccaagaggaatgcaagaggaggctgcctgcggtgcatcttggacggctagagagatgtacccctacttgtgaaggtgcacgaggaagatgaagctgggatcgagcagggcagggcctgggagaggaagcgcgggactcctgcctggcgtccacgagctgcccatgggcatccctgccccctgggggaccagtcctctctccttccacaggaagtgctctctctgggcccctgggaggcccttcctcactctggtcctgctggtttccatcaagcaagttacaggatccctccttgaggaaacgactcggaagtgggctcagtacaaacaggcatgtctgagagacttactcaaggaaccttctggcatattttgtaacgggacatttgatcagtacgtgtgttggcctcattcttctcctggaaatgtctctgtaccctgcccttcatacttaccttggtggagtgaagagagctcaggaagggcctacagacactgcttggctcaggggacttggcagacgatagagaacgccacggatatttggcaggatgactccgaatgctccgagaaccacagcttcaagcaaaacgtggatcgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggctgtggcccagatacctgctgttgggttgggccttccctgtgctatttgttgtaccctggggtttcgcccgtgcacacctggagaacacagggtgctggacaacaaatgggaataagaaaatctggtggatcatccgaggacccatgatgctctgtgtaacagtcaatttcttcatcttcctgaaaattctcaagcttctcatttctaagctcaaagctcatcaaatgtgcttcagagattataaatacagattggcaaaatcaacactggtcctcattcctttattgggcgttcatgagatcctcttctctttcatcactgatgatcaagttgaaggatttgcaaaacttatacgacttttcattcagttgacactgagctcctttcatgggttcctggtggccttgcagtatggttttgccaatggagaggtgaaggctgagctgcggaaatactgggtccgcttcttgctagcccgccactcaggctgcagagcctgtgtcctggggaaggacttccggttcctaggaaaatgtcccaagaagctctcggaaggagatggcgctgagaagcttcggaagctgcagccctcacttaacagtgggcggctcctacatctagccatgcgaggtcttggggagctgggcgcccagccccaacaggaccatgcacgctggccccggggcagcagcctgtccgagtgcagtgagggggatgtcaccatggccaacaccatggaggagattctggaagagagtgagatctagggtggagttccaccaccctggctctgctcccagggactcttgagggggcccaggaagaggaagcaaagcaggacacacgttgctgggcacggaatcattctcgttccattcaccatgccactttgatatgaaagctatcacaaggttcttcaagctctgtatgaaagaggctgtgtgtcatgctcacagcctctgcctgctcttctcatcctaataacccccaccagtgtgttttccacaatgcccaccagaccctagggcctggctctaaattcaagccaatgaagtcccaccatgaagagaggtctcctgttatagagaagccagccaatatctcttcctttatcccttggggtgcatgctttccatctgaggttgggtttagggtgcgtgaaaacctcctaggaagcttttaaaatgcagaatcctagacttgtggctaagattctaagacagtgagtctgggaccatggccaggaattggagctgtttaataagcatcccaggtaattctgctgcaagcccacccttggagaacactgggcagggtgagagggagctagaagcgcccccatgtggccatggcaggatgctgcaagagacagtctgctctcccaggtcagctggggtgtgcctgccctccttggagagtatgtaactccacccaccagagtgccactcctctctgctcttcctctcctatcaagtcttgcctctctctctctttgcctcagttctctgtccctgcacagcaggagttctgcttgatcctccctttgaggattggccccagtgcctggggaccctctgaatgtcgtctttggtctgttcctctcctttctggctctatctacctttctgagtttggcttctaccagcctgatttacactaccattctcttggggcaaggaatgtccccaccatttttggtttgccattgatgcattgattgtcacacctgttgtcccaggaagttgacctataactctccatggccagagtccctgctgatcagaattcaatttgcccagtgggaataaatactgaaagcaggagggcccaggtaaagcaataggagtttggctggatctggacatgcccagggtggctctgagagatccaagactttgcatccaccagcctgtgggatctttcctgcctactgtgacccatggaggctgaggagggcccaggcagttggggtcaggctcaatgactgaaagtatagggcaagaggctgtaggaagatcaagggatggacatcctttggaaacagtgtgttaatgcacaggagtgtcactttcatggtatgtaaaatgcatgtgtacgtgggtggggtatgttgctatgggactaaataccaccttgtcttcgggggagtcagtttgatactcctcaagcagggctgccatatttagcaaacaaaaacaaggtactcaattaaatttgaatttcagacaaatagtcttcttgtataagtatatcccatgggcatatttaatctgagattggaattcaatcatgcatcttgtcttttactggcatctctgttttcaaggatactttgccacagggctgggactagggtgaaataatcaaggcactcatctctaaaaagctcaaagtaaatgatcaaaataaatcatattttaatgcaatattctaaaaaaacaaattaacaaactacagcccatgagccatttatagaaatgaaatttgattggagccaggggcaggataagggtgaggcaggagaggccagctcttgcaagtgcaggctctggtcctgactttcaaatgttgtctatgagggacttttaatgtgaatttttatttttagacaattgcattaaaatgttatttatattgactatggggacttttggggcccccttaaattttgcacttgaaatgggatccccacttgtgtcaccccatagtccagccctggttttaggatggggatggaggcaaaggcatcaggcaagtaatgaagcaaaggtttattttttggtgtccagattatccatagctcagtcatgaaaatctatgtctttctatttttctcctttctgcaaatgtccctgcctcggctcatcagccaattagctcctagaaagctggggtcatctcgtattcccagcaagtacccagcacagtgccggttcagagcaggtgctccacacacattcctggaatgagacagcacagaaatggctctcgggagcctcggatgctgctgggagtaagtgatccaggaccttaccgctaagaggagaaactttttttcaaagcatttataaatactccctccacccctcactccacaaatggggtgatcaacacttactgcttgctcttgttctgctaatgattaaaacaagtttatttaattt

SEQ ID NO: 8555 - DNA, 2606 bp, Homo sapiens
  ENST00000458005
agattgctctagaccgcctcagacactctcggcgcagcgtggagaggatttgtgcaaacatttcctctgtggaccaagaggaatgcaagaggaggctgcctgcggtgcatcttggacggctagagagatgtacccctacttgtgaaggtgcacgaggaagatgaagctgggatcgagcagggcagggcctgggagaggaagcgcgggactcctgcctggcgtccacgagctgcccatgggcatccctgccccctgggggaccagtcctctctccttccacaggaagtgctctctctgggcccctgggaggcccttcctcactctggtcctgctggtttccatcaagcaagttacaggatccctccttgaggaaacgactcggaagtgggctcagtacaaacaggcatgtctgagagacttactcaaggaaccttctggctgactcttcgggtgcagccacgtgcaccatgcccacctccaaaagaaaaaaagaagaaagtaccttggcccgttgcctctgagcctactgaggacaatccccggctccggctgctttcagatcattttattcagaggccttgagattgacaggacactgtgaactctccctgtctttcttcacccaaaggcagtcccaggcttcaagcccttcccagctccctttgaagacctcatgggcccaggcatattttgtaacgggacatttgatcagtacgtgtgttggcctcattcttctcctggaaatgtctctgtaccctgcccttcatacttaccttggtggagtgaagagagctcaggaagggcctacagacactgcttggctcaggggacttggcagacgatagagaacgccacggatatttggcaggatgactccgaatgctccgagaaccacagcttcaagcaaaacgtggatcgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggctgtggcccagatacctgctgttgggttgggccttccctgtgctatttgttgtaccctggggtttcgcccgtgcacacctggagaacacagggtgctggacaacaaatgggaataagaaaatctggtggatcatccgaggacccatgatgctctgtgtaacagcacttggactagaggaaacgggcttgaagagaaatgggagcattccctttggtcacaaggaagacatttaaccatgaacttgtaaaacactgacatataccccagagaaaggcattagatcttcatgtctatcagtttacaagaagataatctgtcctgaacaataaggagctaaacctgctgccctcccaatctgcacagctctaggattctaggactctgtgcattggttctagggctccccagagagtggaatttatgtgtcccaccagacatggaagggaaaagaaaggccatgcagaaagaagtgaaagaggcaggctaggagtcaggagcctgggctctatgactgacttgtgatgtgtccttcagccaggtgagttggcctctctgggcctctgtttcttcatctatgaaatcagtcttgaactagaccagtggttttcaaccagaggagattctgacccctggggacatttggctgtgtctggagacatttttaattgtcataaattggggatggggataggaggagaatgttgctactggcatctagtgggtggaggtcagggatgctgctcaacaccctacaacacacagaaccacccccagaataaataattatcctgccccaaatattaagagtgccaacattgaaaaaccctggactagacagtagctgcacattaaaacaacctggggaggattaaaaaaatacccagcccagacttacccagactgatggaatcaaatctcctgccatgtagagcttccttagcactggaatctcattcagccactctcttgtatcttcctttagcattcattgagcaccttcactgggcttggcttggtgctaggttatttcagagtttctatcctcagggaattcagaatttaatagttatcattctgagactcatcagactatgactgaaccaatatctgccttcatttttggtcatatgaccacatgttgcaattttccactgatctgaatagacataaccccaactctaaaagagaattccttaaaccacaacgtggaaggaacctggattcctgaatgactgtatggagcagaactccctccactgcactagactgtgacataaccaataaaataaaataagataaaataaa

SEQ ID NO: 8556 - DNA, 523 bp, Homo sapiens
  ENST00000304773
ttactttcagagagctcaggaagggcctacagacactgcttggctcaggggacttggcagacgatagagaacgccacggatatttggcaggatgactccgaatgctccgagaaccacagcttcaagcaaaacgtggatcgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggc

SEQ ID NO: 8557 - DNA, 1803 bp, Homo sapiens
  ENST00000274576
gggagccaacagacacgctggagtttaacaaacagcaatactcttcgcgctcctgaaaagcaggtctggacgctctccgtggtgctgaaacgcctcgcagccgccgctgtccgtggtatctacgaccccctcgctccaatttcccctggggctctccctccgcgcccctgttccccgcctccctttaacatctggattattttttgcaatagcgctttctggttttgtaagtgccaatttgaaacatttttgcccccataactcgtggactacaaagcacaaggacctgaaaaatgtacagcttcaatactcttcgactctacctttgggagaccattgtattcttcagccttgctgcttctaaggaggctgaagctgctcgctccgcacccaagcctatgtcaccctcggatttcctggataagctaatggggagaacctccggatatgatgccaggatcaggcccaattttaaaggtcccccagtgaacgtgagctgcaacattttcatcaacagctttggttccattgctgagacaaccatggactatagggtcaacatcttcctgcggcagcaatggaacgacccccgcctggcctataatgaataccctgacgactctctggacctggacccatccatgctggactccatctggaaacctgacctgttctttgccaacgagaagggggcccacttccatgagatcaccacagacaacaaattgctaaggatctcccggaatgggaatgtcctctacagcatcagaatcaccctgacactggcctgccccatggacttgaagaatttccccatggatgtccagacatgtatcatgcaactggaaagctttggatatacgatgaatgacctcatctttgagtggcaggaacagggagccgtgcaggtagcagatggactaactctgccccagtttatcttgaaggaagagaaggacttgagatactgcaccaagcactacaacacaggtaaattcacctgcattgaggcccggttccacctggagcggcagatgggttactacctgattcagatgtatattcccagcctgctcattgtcatcctctcatggatctccttctggatcaacatggatgctgcacctgctcgtgtgggcctaggcatcaccactgtgctcaccatgaccacccagagctccggctctcgagcatctctgcccaaggtgtcctatgtgaaagccattgacatttggatggcagtttgcctgctctttgtgttctcagccctattagaatatgctgccgttaactttgtgtctcggcaacataaggagctgctccgattcaggaggaagcggagacatcacaaggaggatgaagctggagaaggccgctttaacttctctgcctatgggatgggcccagcctgtctacaggccaaggatggcatctcagtcaagggcgccaacaacagtaacaccaccaacccccctcctgcaccatctaagtccccagaggagatgcgaaaactcttcatccagagggccaagaagatcgacaaaatatcccgcattggcttccccatggccttcctcattttcaacatgttctactggatcatctacaagattgtccgtagagaggacgtccacaaccagtgaagggtctgaaaggttgggggaggctgggagaggggaacgtgggaatagcacaggaatctgagagactaaggaagagaaggggaacggagggagggggcacacttacacaactctctctgcaatatgtgcaatagcaaaatgcagtgatgcatgaatttta

SEQ ID NO: 8558 - DNA, 1555 bp, Homo sapiens
  ENST00000462581
caacagacacgctggagtttaacaaacagcaatactcttcgcgctcctgaaaagcaggtctggacgctctccgtggtgctgaaacgcctcgcagccgccgctgtccgtggtatctacgaccccctcgctccaatttcccctggggctctccctccgcgcccctgttccccgcctccctttaacatctggattattttttgcaatagcgctttctggttttgtaagtgccaatttgaaacatttttgcccccataactcgtggactacaaagcacaaggacctgaaaaatgtacagcttcaatactcttcgactctacctttgggagaccattgtattcttcaggtcccccagtgaacgtgagctgcaacattttcatcaacagctttggttccattgctgagacaaccatggactatagggtcaacatcttcctgcggcagcaatggaacgacccccgcctggcctataatgaataccctgacgactctctggacctggacccatccatgctggactccatctggaaacctgacctgttctttgccaacgagaagggggcccacttccatgagatcaccacagacaacaaattgctaaggatctcccggaatgggaatgtcctctacagcatcagaatcaccctgacactggcctgccccatggacttgaagaatttccccatggatgtccagacatgtatcatgcaactggaaagctttggatatacgatgaatgacctcatctttgagtggcaggaacagggagccgtgcaggtagcagatggactaactctgccccagtttatcttgaaggaagagaaggacttgagatactgcaccaagcactacaacacaggtaaattcacctgcattgaggcccggttccacctggagcggcagatgggttactacctgattcagatgtatattcccagcctgctcattgtcatcctctcatggatctccttctggatcaacatggatgctgcacctgctcgtgtgggcctaggcatcaccactgtgctcaccatgaccacccagagctccggctctcgagcatctctgcccaaggtgtcctatgtgaaagccattgacatttggatggcagtttgcctgctctttgtgttctcagccctattagaatatgctgccgttaactttgtgtctcggcaacataaggagctgctccgattcaggaggaagcggagacatcacaaggaggatgaagctggagaaggccgctttaacttctctgcctatgggatgggcccagcctgtctacaggccaaggatggcatctcagtcaagggcgccaacaacagtaacaccaccaacccccctcctgcaccatctaagtccccagaggagatgcgaaaactcttcatccagagggccaagaagatcgacaaaatatcccgcattggcttccccatggccttcctcattttcaacatgttctactggatcatctacaagattgtccgtagagaggacgtccacaaccagtgaagggtctgaaaggttgggggaggctgggagaggggaacgtgggaat

SEQ ID NO: 8559 - DNA, 1707 bp, Homo sapiens
  ENST00000455880
caacagacacgctggagtttaacaaacagcaatactcttcgcgctcctgaaaagcaggtctggacgctctccgtggtgctgaaacgcctcgcagccgccgctgtccgtggtatctacgaccccctcgctccaatttcccctggggctctccctccgcgcccctgttccccgcctccctttaacatctggattattttttgcaatagcgctttctggttttgtaagtgccaatttgaaacatttttgcccccataactcgtggactacaaagcacaaggacctgaaaaatgtacagcttcaatactcttcgactctacctttgggagaccattgtattcttcagccttgctgcttctaaggaggctgaagctgctcgctccgcacccaagcctatgtcaccctcggatttcctggataagctaatggggagaacctccggatatgatgccaggatcaggcccaattttaaaggtcccccagtgaacgtgagctgcaacattttcatcaacagctttggttccattgctgagacaaccatggactatagggtcaacatcttcctgcggcagcaatggaacgacccccgcctggcctataatgaataccctgacgactctctggacctggacccatccatgctggactccatctggaaacctgacctgttctttgccaacgagaagggggcccacttccatgagatcaccacagacaacaaattgctaaggatctcccggaatgggaatgtcctctacagcatcagaatcaccctgacactggcctgccccatggacttgaagaatttccccatggatgtccagacatgtatcatgcaactggaaagctttggatatacgatgaatgacctcatctttgagtggcaggaacagggagccgtgcaggtagcagatggactaactctgccccagtttatcttgaaggaagagaaggacttgagatactgcaccaagcactacaacacaggtaaattcacctgcattgaggcccggttccacctggagcggcagatgggttactacctgattcagatgtatattcccagcctgctcattgtcatcctctcatggatctccttctggatcaacatggatgctgcacctgctcgtgtgggcctaggcatcaccactgtgctcaccatgaccacccagagctccggctctcgagcatctctgcccaaggtgtcctatgtgaaagccattgacatttggatggcagtttgcctgctctttgtgttctcagccctattagaatatgctgccgttaactttgtgtctcggcaacataaggagctgctccgattcaggaggaagcggagacatcacaagagccccatgttgaatctattccaggaggatgaagctggagaaggccgctttaacttctctgcctatgggatgggcccagcctgtctacaggccaaggatggcatctcagtcaagggcgccaacaacagtaacaccaccaacccccctcctgcaccatctaagtccccagaggagatgcgaaaactcttcatccagagggccaagaagatcgacaaaatatcccgcattggcttccccatggccttcctcattttcaacatgttctactggatcatctacaagattgtccgtagagaggacgtccacaaccagtgaagggtctgaaaggttgggggaggctgggagaggggaacgtgggaat

SEQ ID NO: 8560 - DNA, 1802 bp, Homo sapiens
  ENST00000471351
agacacgctggagtttaacaaacagcaatactcttcgcgctcctgaaaagcaggtctggacgctctccgtggtgctgaaacgcctcgcagccgccgctgtccgtggtatctacgaccccctcgctccaatttcccctggggctctccctccgcgcccctgttccccgcctccctttaacatctggattattttttgcaatagcgctttctggttttgtaagtgccaatttgaaacatttttgcccccataactcgtggactacaaagcacaaggacctgaaaaatgtacagcttcaatactcttcgactctacctttgggagaccattgtattcttcagccttgctgcttctaaggaggctgaagctgctcgctccgcacccaagcctatgtcaccctcggatttcctggataagctaatggggagaacctccggatatgatgccaggatcaggcccaattttaaaggtcccccagtgaacgtgagctgcaacattttcatcaacagctttggttccattgctgagacaaccatggactatagggtcaacatcttcctgcggcagcaatggaacgacccccgcctggcctataatgaataccctgacgactctctggacctggacccatccatgctggactccatctggaaacctgacctgttctttgccaacgagaagggggcccacttccatgagatcaccacagacaacaaattgctaaggatctcccggaatgggaatgtcctctacagcatcagaatcaccctgacactggcctgccccatggacttgaagaatttccccatggatgtccagacatgtatcatgcaactggaaagctttggatatacgatgaatgacctcatctttgagtggcaggaacagggagccgtgcaggtagcagatggactaactctgccccagtttatcttgaaggaagagaaggacttgagatactgcaccaagcactacaacacaggtaaattcacctgcattgaggcccggttccacctggagcggcagatgggttactacctgattcagatgtatattcccagcctgctcattgtcatcctctcatggatctccttctggatcaacatggatgctgcacctgctcgtgtgggcctaggcatcaccactgtgctcaccatgaccacccagagctccggctctcgagcatctctgcccaagggtccggtttgaaattcccactgggcaggcatgacctcagcattagtacccaccatcttggctccagcatacaagcaggcctggtaatgggcctccacgatgtccctgccatgggctttgcctgctcccacactgcagtaatatggaccctggggtcctgggaagccattggaaggccaaccaaagtggtacccatctgtccccatgagggtatattcctgctccatgccaaaccagggtgctggttgctcaccatgtccattatccacttacaagtgtgcctcaaattggtcactgcaggctttcggttgtactcgaaaacttcacagaacaccagcttgtagggtccttactgaaggtatcccaaaacatggcaggaggcatgaaatgcatgtcactgttggagccttcagactgtaaaatactagagccatcaaaattctaggctaggcatggtggctcatgcctgtaatcccaggactctgggaggccaaggcagttggatcacctgaggtcaggagttggagaccagcctggccaacatagtgaaaccacgtctctactaaaaatacaaaaaattagctgggcgtagtcacacacacctgta

SEQ ID NO: 8561 - DNA, 3039 bp, Homo sapiens
  ENST00000277865
gggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 8562 - DNA, 409 bp, Homo sapiens
  ENST00000487058
aaaataacctctatttaactttaactgaaactgtgcttctccccacagccccttgttcatatatgcacatctcttgccctcagtggaggggatttgacggtggtgttcgcatttctctatgttcctgactctcttgcagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtaccc

SEQ ID NO: 8563 - DNA, 503 bp, Homo sapiens
  ENST00000465164
ggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaaggtgacaacattatagaaaccagaaccaacattatcaatgtgaatgacgttaggggggtcatagaagagtctgattgagttttctctttctttttagcagctttattggcacatactgcacataccatacagttcccccatttaaggtacataatttaatggcttttagctaccggcacagagttgtgcaaccattaccaaaacaaacgcatctgcctgacactcctg

SEQ ID NO: 8564 - DNA, 394 bp, Homo sapiens
  ENST00000474574
cagggcagcccactgtgctaagacactagaacgtacatcaagaagcatccaattctgatttttccctcagagggcttccatttaaagaggaactaaggtgcataagcagataaggatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccag

SEQ ID NO: 8565 - DNA, 4364 bp, Homo sapiens
  ENST00000331872
gtaaaactattccccgtgaaggcggcagggcagaggtccagggcgggctttgctgggagcctcgggaccccgggttgggggccgtggggcggcacctggcgagctggcgggtgggcggcgagccgaggcttcccggcctggcggcaactcgcccctctgccctcagccctcccggctccgctcccttcccccacgccgccctgcccctcccccacgcccctttctctttctttctttctttcccagttcgcttgcccccaccccagcggcgcccgccgggctcctcgcccaatggccgcggggcccgggaccgcatcagctgatcggcccgggctcctggccgctgggagccaatcagggcaccgggggcggccccgggccgcggataaagggtgcggggctgctggcggctctgcagagtcgagagtgggagaagagcggagcgtgtgagcagtactgcggcctcctctcctctcctaacctcgctctcgcggcctagctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagatctctctgatgtgtttgtgattctttcaaatccctatgtgccattatatttctttatttcctaaaacaggcaaaataagctcaagtttatgtactctgagtttttaaaacactggagtgatgttgctgaccagccgtttcctgtacctctctaagttgggtatttgggacttaagggattaagtttttcacctagacttagttacacacaatcttggcatttcctagcctagaggtttgtagcagggtacaagccccactcctcccccttcctttgctcccctgagtttggttttggcttaccataacattgttttgaccattcctagcctaatacaatagcctaacataatgtaagattaactggctttacgatttctattctctgctctcagtgataagaaacaaatattagctaccctgctaccctggttgaagccttccaaggctggctatgccctaggcatgggctcatccttgggtgtatcttgccttgcaggaagaccagtggaccgattgtgattctcaaaagctctgtgttgtcacctgtgcccttgccccttgctcttatcttggtccgtgtatctgggagttcttccaccttatcttggccaattcctaccttcgttcattcctcatgaggttgggtaaaagctccctccggctcccatgatgctgtgcatatacctagcaaaaagcaattattggacacattggagtgcaatattattaatagcattaatactactaataatgtgggcaatagtgattgtttttaaaaggcagtatactcttaccagtgcgaggtagctggggcctgtgatagtttttagagataagttcttcaggcaactgtgtattttacactagtcaagtaatcctagatatccgtggtttttcttaagaaagttggctcgtaatatgatttaatattcaaagtagagtcatctacctattagcttgctggcgtggtcctagtttatgcctgtttcagcatgattgttgagtaccctgtttcatccttagcattttcttgattttgttgttaaatgatgtatacccttatttccattgaatctgtgcttccacccccccaactgaagttgtcttccctttgcttggccacccttacagcctcttggatggtgtatcctacagtgtaagcactaaactgaagaggcagtgacctga

SEQ ID NO: 8566 - DNA, 6132 bp, Homo sapiens
  ENST00000491322
aagtgtgcatgatattggtggtgtaacatgttggagaggacagccgagaaattgggttgtaggttttttttttttgttttccgacagagtctctatctgttacccaggttggagtgcagtggtgcaatctcccggctcactgcaacctctgcctctggggttcaggcgattctcctgtgtcagcctcccgagtagctgggattacaggcgtgcacaaccacgcccggctaatttttgtatttttagtagagacgggagtttcatcgtgttggccaggctggtctcgaactttgtacctcaggtgatctgcccgcttcggtgggttgtagcttttagcgggagctaaagggttctgggatggaggtgggaagtaggatttggccggctgagtcttctagaggcaatattggggtgttggtcttccccaaggggaagggtggtgaggctgagggagaagcagttatgttttcagctgggcaaacatggacggttgcccgtagaaactttgccactgtacttcagaacgttgccctagtcgttggaggagaacaatgtgttccctttctagccaccctggtccacggagggaggagggagagagagaatgtttcctcttcggctgttgtggcttgagagtttctcttctttcggaggttttgtggtagtggctggcagttattagtatgcctcatggcttttaaatttccagatctttttgatttagaagtggaaatttcctaattacttgacaagtcttgtagaattccataatgttgtgattcttgcccactatcttaagtgagactttgcatgagacctatggaaattatggcagcattccccttagaatctggcttgaatcagcttttgtgtaggaaactgctagccttctaaaaaaatatattgtaaccttgtttcatcctcaaatctaaatgtgtaatgagttttcttttggtggggaggggcggtgggtttgagttaagaccacagctaggatgaaagacaaagagaaaaacaaactgtggaagccaagcctgttctgtggctggattttacttatattggaagaagttctatgttttgtaaatttgtgtattggttttgatttgtttcctctgatagtttagtatttggatagtttagtgttaacctcagctacactgaaggaatagaccttagtcctcacaagtataagttctagcttggaagcctgggttctgcagtagctgtggaacttaagcctgtgagctcagggatgcagaggcattgagttactaccaagggcctgatcttttctttagcaggcatctgtgttaattgtttcaaaaggtggtgatcagttttacagcctattataaaggagatttttgcctactataaaactaatccccctgaaagagtgagtaaacataactttttgtgtgttgacttccacaagggaaggagttggcacttacactctgacttttgattcagtcgtccttcttgagccatttttgcaggggatcagtttggagtgggcgttaacaatgttattctttttttcttctccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcaggtgtgttatagcacagctatggatacccctcctcaatctgtgaatgctgtgaaggggagggagaagacattctgaaatcagcattgggaagactaggcaatttcagcactattttaagaatctgagtgattcttttccctgaacttctgctttgaggaagagataatatggcccatctttctatggtcttctctgttggttgcataaaatagcattggatttgtccagatctgtttgccggtcttggagtccccagtaacagccttcctgcctggaatgtaggccaggacaaatgtaaaccaatggacaaatgtttctcaaaaattatagaatggctccaagtgcctgagaaatgaagaataaatctgacaaccagaagcagctgtcttgtgaatagagggttaagtgcctggcatttggtgcttgggaggtggccagaatgcagataaggtgaaagttgccctgttctaaatccactcccatgtgacttggttgtaactgagtttagttaaaactgaagtctttcagagtcttcctacagatgtacaattaacagcttctctcatttttctgactcggtgatcccaagaaggcctatactgggtcagttcataccatagtgcacacctcagttgtatagaatccaaggactattctcccatcagcatcggtattcagcatctatgtctttagatccctgatggcgtattattgactcttttttctagagaccaatttgaggcacacctgtaaacggataatggacatggtgagcaaccagcacccctggtttggcatggagcaggagtataccctcatggggacagatgggcacccctttggttggccttccaacggcttcccagggccccagggtaagtctccttgggttagaggtgaaattcccagaagtgtctaactgtgcaggaatgccccttcccagggatgggaatgactttcagaatcaagaagcaaaataatacagtaaaggcgaaacagccctcacatcaccaaagtccaaaaatggatatgaatatataaagtaaggttttagggggaacgtttggccccactgaagctgtggtgaagaggaactcccctattgcccctcccctgccccgcacctgcagatgaaggcaaggatagtgattcaagagggcaaggcttaagggccttctgatctctgactttgggattctctggatttcttgactcttagtgttttgtcctgatgcttctgtaggtccatattactgtggtgtgggagcagacagagcctatggcagggacatcgtggaggcccattaccgggcctgcttgtatgctggagtcaagattgcggggactaatgccgaggtcatgcctgcccaggtaagtatagctccaatccatcaatgaagaagggtaggtaggtgtacataggacttttgctagtaagggctgctgatacaccactcactaacccaaaacctaagaacgggttggagtacaggtgagaagagaacaggtttaggagattctgagttggagtgagcagttagctttgttttaatggccaagcttctcgtt[450 bp omitted]ataatttatataatatatattagtcatatatcattatataaatatatatcgatatatatatttgtgacatatgtcatggtgacagggaaaagttgacaaattcatgcatttgaaaatcttttagaactaaattagtaacaatacaggcatgtggataagcttaatgcttatgagggggagaaagtttcaaatgattagtcttttcaacaaacagtaactttgtactgcttgtcgggcactgttctcaccactgagacacacaggtaagaagatgcagccactgccctcatgaagtatttgttctactggtatcatattttggtgcacttcattcttggctccatacctggagacaaggttggactgccatcttttctgtttactctaggtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataaga

SEQ ID NO: 8567 - DNA, 3942 bp, Homo sapiens
  ENST00000339526
gcagagtcgagagtgggagaagagcggagcgtgtgagcagtactgcggcctcctctcctctcctaacctcgctctcgcggcctagctttacccgcccgcctgctcggcgaccaggtaagcccccggacggcccggtgtcacgcaagcgaggcgcgccgcccctgctaccccgcgaggcgcgccgcccagcctcttttttcggctgcctgcccctccagtcccagccctacgctgcggcctctccggcccatgcctgagatccggcatgagtgctcctcccgcgtgcttccgccgctggtggcttggacccgtcggggctggcgctggtggggcgcgcccttggccaggctctgggaagggcggggtgagttgttttgatcttcttttcactacttgcggccgaagcgccgcccctggaggccgttgggccggcctgcgccctggggctcgcagtggtttgtttgcgctgtggatggagtggcggtgcggtcccctgtggagcgcaaacaaggcgcttggttggcgcgggcgcctggctgccttcctcgtggtggggccttcggagcaatcgtcctggttctggcgatggttgagacgcctcgattgcggcgtgtaacggtgagcgttgtttgggcggccggctcccgcctcggggtcccgggggccttccaatgtgaccgaacaatggagagcccgggcctcggcgcagtcagtggagaagccggtccgggcggaggcagcagcagcgcgcagtccctacggcctgcgcccccaccctcccccggaccccccaacccctcggcggcagggtatggccacctccgtgaggccctgagattcggacgggggcccgaggggcagggcgcccactttagggacatttcagtgggaaggggctgctctcaaagtggataattataactccctcgggggcgggaagcggggatcctcccccagccgcaagtccacgaagaaagcaacgaatgaaaattatgaagacaacgagaagtcagactcctccgggtcgcgctccagctgcttcggcttcgtcgcctactctgtgaactccggggagagatctcgagtcaagattaagaccttaacccaccaacctgcctgttcggacaccccccgggccggccgctgtctgtccccttctccatcgccctctcccagaaagctccggtgcttggaccagctagagtctgagaaagaggagaggcgcgaacgccactccaaaaagagaagggttaaagagggcaaccctaacgatacgcttgactttctgtggctgggaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataaga

SEQ ID NO: 8568 - DNA, 939 bp, Homo sapiens
  ENST00000463851
tgagcagtactgcggcctcctctcctctcctaacctcgctctcgcggcctagctttacccgcccgcctgctcggcgaccagaacaccttccaccatgaccacctcagcaagttcccacttaaataaagacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttt

SEQ ID NO: 8569 - DNA, 689 bp, Homo sapiens
  ENST00000461447
gggattctctggatttcttgactcttagtgttttgtcctgatgcttctgtaggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagta

SEQ ID NO: 8570 - DNA, 1369 bp, Homo sapiens
  ENST00000484996
aagagcggagcgtgtgagcagtactgcggcctcctctcctctcctaacctcgctctcgcggcctagctttacccgcccgcctgctcggcgaccaggtaagcccccggacggcccggtgtcacgcaagcgaggcgcgccgcccctgctaccccgcgaggcgcgccgcccagcctcttttttcggctgcctgcccctccagtcccagccctacgctgcggcctctccggcccatgcctgagatccggcatgagtgctcctcccgcgtgcttccgccgctggtggcttggacccgtcggggctggcgctggtggggcgcgcccttggccaggctctgggaagggcggggtgagttgttttgatcttcttttcactacttgcggccgaagcgccgcccctggaggccgttgggccggcctgcgccctggggctcgcagtggtttgtttgcgctgtggatggagtggcggtgcggtcccctgtggagcgcaaacaaggcgcttggttggcgcgggcgcctggctgccttcctcgtggtggggccttcggagcaatcgtcctggttctggcgatggttgagacgcctcgattgcggcgtgtaacgaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgcc

SEQ ID NO: 8571 - DNA, 683 bp, Homo sapiens
  ENST00000489818
agagtcgagagtgggagaagagcggagcgtgtgagcagtactgcggcctcctctcctctcctaacctcgctctcgcggcctagctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtccatattactgtggtgtgggagcagacagagcctatggcagggacatcgtggaggcccattaccgggcctgcttgtatgctggagtcaagattgcggggactaatgccgaggtcatgcctgcccaggtaagtatagctccaatccatcaatgaagaagggtaggtaggtgtacataggacttttgct

SEQ ID NO: 8572 - DNA, 868 bp, Homo sapiens
  ENST00000475808
ttaagcctgtgagctcagggatgcagaggcattgagttactaccaagggcctgatcttttctttagcaggcatctgtgttaattgtttcaaaaggtggtgatcagttttacagcctattataaaggagatttttgcctactataaaactaatccccctgaaagagtgagtaaacataactttttgtgtgttgacttccacaagggaaggagttggcacttacactctgacttttgattcagtcgtccttcttgagccatttttgcaggggatcagtttggagtgggcgttaacaatgttattctttttttcttctccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtaagtctccttgggttagaggtgaaattcccagaagtgtctaactgtgcaggaatgcccc

SEQ ID NO: 8573 - DNA, 908 bp, Homo sapiens
  ENST00000480604
tgagcagtactgcggcctcctctcctctcctaacctcgctctcgcggcctagctttacccgcccgcctgctcggcgaccagcggggatcctcccccagccgcaagtccacgaagaaagcaacgaatgaaaattatgaagacaacgagaagtcagactcctccgggtcgcgctccagctgcttcggcttcgtcgcctactctgtgaactccggggagagatctcgagtcaagattaagaccttaacccaccaacctgcctgttcggacaccccccgggccggccgctgtctgtccccttctccatcgccctctcccagaaagctccggtgcttggaccagctagagtctgagaaagaggagaggcgcgaacgccactccaaaaagagaagggttaaagagggcaaccctaacgatacgcttgactttctgtggctgggaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacgg

SEQ ID NO: 8574 - DNA, 793 bp, Homo sapiens
  ENST00000462444
gaagagcggagcgtgtgagcagtactgcggcctcctctcctctcctaacctcgctctcgcggcctagctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcaggtgtgttatagcacagctatggatacccctcctcaatctgtgaatgctgtgaaggggagggagaagacattctgaaatcagcattgggaagactaggcaatttcagcactattttaagaatctgagtgattcttttccctgaacttctgctttgaggaagagataatatggcccatctttctatggtcttctctgttggttgcataaaatagcattggatttgtccagatctgtttgccggtcttggagtccccagtaacagccttcctgcctggaatgtaggccaggacaaatgtaaaccaatggacaaatgtttctcaaaaattatagaatggctccaagtgcctgagaaatga

SEQ ID NO: 8575 - DNA, 4719 bp, Homo sapiens
  ENST00000311223
gtaaaactattccccgtgaaggcggcagggcagaggtccagggcgggctttgctgggagcctcgggaccccgggttgggggccgtggggcggcacctggcgagctggcgggtgggcggcgagccgaggcttcccggcctggcggcaactcgcccctctgccctcagccctcccggctccgctcccttcccccacgccgccctgcccctcccccacgcccctttctctttctttctttctttcccagttcgcttgcccccaccccagcggcgcccgccgggctcctcgcccaatggccgcggggcccgggaccgcatcagctgatcggcccgggctcctggccgctgggagccaatcagggcaccgggggcggccccgggccgcggataaagggtgcggggctgctggcggctctgcagagtcgagagtgggagaagagcggagcgtgtgagcagtactgcggcctcctctcctctcctaacctcgctctcgcggcctagctttacccgcccgcctgctcggcgaccagcggggatcctcccccagccgcaagtccacgaagaaagcaacgaatgaaaattatgaagacaacgagaagtcagactcctccgggtcgcgctccagctgcttcggcttcgtcgcctactctgtgaactccggggagagatctcgagtcaagattaagaccttaacccaccaacctgcctgttcggacaccccccgggccggccgctgtctgtccccttctccatcgccctctcccagaaagctccggtgcttggaccagctagagtctgagaaagaggagaggcgcgaacgccactccaaaaagagaagggttaaagagggcaaccctaacgatacgcttgactttctgtggctgggaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagatctctctgatgtgtttgtgattctttcaaatccctatgtgccattatatttctttatttcctaaaacaggcaaaataagctcaagtttatgtactctgagtttttaaaacactggagtgatgttgctgaccagccgtttcctgtacctctctaagttgggtatttgggacttaagggattaagtttttcacctagacttagttacacacaatcttggcatttcctagcctagaggtttgtagcagggtacaagccccactcctcccccttcctttgctcccctgagtttggttttggcttaccataacattgttttgaccattcctagcctaatacaatagcctaacataatgtaagattaactggctttacgatttctattctctgctctcagtgataagaaacaaatattagctaccctgctaccctggttgaagccttccaaggctggctatgccctaggcatgggctcatccttgggtgtatcttgccttgcaggaagaccagtggaccgattgtgattctcaaaagctctgtgttgtcacctgtgcccttgccccttgctcttatcttggtccgtgtatctgggagttcttccaccttatcttggccaattcctaccttcgttcattcctcatgaggttgggtaaaagctccctccggctcccatgatgctgtgcatatacctagcaaaaagcaattattggacacattggagtgcaatattattaatagcattaatactactaataatgtgggcaatagtgattgtttttaaaaggcagtatactcttaccagtgcgaggtagctggggcctgtgatagtttttagagataagttcttcaggcaactgtgtattttacactagtcaagtaatcctagatatccgtggtttttcttaagaaagttggctcgtaatatgatttaatattcaaagtagagtcatctacctattagcttgctggcgtggtcctagtttatgcctgtttcagcatgattgttgagtaccctgtttcatccttagcattttcttgattttgttgttaaatgatgtatacccttatttccattgaatctgtgcttccacccccccaactgaagttgtcttccctttgcttggccacccttacagcctcttggatggtgtatcctacagtgtaagcactaaactgaagaggcagtgacctg

SEQ ID NO: 8576 - DNA, 4065 bp, Homo sapiens
  ENST00000417584
actacttgcggccgaagcgccgcccctggaggccgttgggccggcctgcgccctggggctcgcagtggtttgtttgcgctgtggatggagtggcggtgcggtcccctgtggagcgcaaacaaggcgcttggttggcgcgggcgcctggctgccttcctcgtggtggggccttcggagcaatcgtcctggttctggcgatggttgagacgcctcgattgcggcgtgtaacgaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagatctctctgatgtgtttgtgattctttcaaatccctatgtgccattatatttctttatttcctaaaacaggcaaaataagctcaagtttatgtactctgagtttttaaaacactggagtgatgttgctgaccagccgtttcctgtacctctctaagttgggtatttgggacttaagggattaagtttttcacctagacttagttacacacaatcttggcatttcctagcctagaggtttgtagcagggtacaagccccactcctcccccttcctttgctcccctgagtttggttttggcttaccataacattgttttgaccattcctagcctaatacaatagcctaacataatgtaagattaactggctttacgatttctattctctgctctcagtgataagaaacaaatattagctaccctgctaccctggttgaagccttccaaggctggctatgccctaggcatgggctcatccttgggtgtatcttgccttgcaggaagaccagtggaccgattgtgattctcaaaagctctgtgttgtcacctgtgcccttgccccttgctcttatcttggtccgtgtatctgggagttcttccaccttatcttggccaattcctaccttcgttcattcctcatgaggttgggtaaaagctccctccggctcccatgatgctgtgcatatacctagcaaaaagcaattattggacacattggagtgcaatattattaatagcattaatactactaataatgtgggcaatagtgattgtttttaaaaggcagtatactcttaccagtgcgaggtagctggggcctgtgatagtttttagagataagttcttcaggcaactgtgtattttacactagtcaagtaatcctagatatccgtggtttttcttaagaaagttggctcgtaatatgatttaatattcaaagtagagtcatctacctattagcttgctggcgtggtcctagtttatgcctgtttcagcatgattgttgagtaccctgtttcatccttagcattttcttgattttgttgttaaatgatgtatacccttatttccattgaatctgtgcttccacccccccaactgaagttgtcttccctttgcttggccacccttacagcctcttggatggtgtatcctacagtgtaagcactaaactgaagaggcagtgacctg

SEQ ID NO: 8577 - DNA, 1308 bp, Homo sapiens
  ENST00000388923
aactacttaaatcttcccaaatctggtgcccataccttctatggcaggggcttttagcaccattctttaacgttagacacataaccacagcctaatcacttgaaccatttaatccttaccagcctctagcattatcctaaaaccctgaacctcttccagctttcttaaactttcagcttttcttgaaacgactttttctgattctaagattattttaactgtaagtaggagaagacatctgaaatttaactatgatcagaaattcagattacaaaaactttgtttgctgtgctgtttgtaataaaataattccaccagccccttttggaaaaaccttcaaacggatccatgaatacaagccacttaagacacgcttttacactcacaaagacatactagatattggggcaaatattctgaaaaaagaagagcagtttcaagaagatatactcagagaacacattgcgaaagcagaagctgaagtatgggctcaggctaatgaacgtcaaaaacaagcagtggagaaagcacttgaagaagcaaatgacagacacaaaattgaaattcagattttgaaagaggaacatcagaaagatttacaggaagtgacagctaaaactaagacagagatgtatcaaaacatggatgacgaaatgaagagagagcacttggctgcagaacagcgcatggtccacagaatccaaaggattatgatggaatgccacagagagaaggtcgaagctgtggagaaagccagggctgaagaaagacacatcgcccaggaagcaatccaggcccagaaaagcaaagccgtggaggaaattgtgaatactggtgtcacagttattaaggatgagaagaccagtgtggcccgactgatgagggaaaaagaacatgaaatgagcatcctctatggcatagctcagaggcagaggcaagaagaggtacaggaagtgcttcaagaagcagagaaaacacatcaggccactcttggcaatatgatggataaactggctaacacccagggggagctgctgtctatagcaaaacaactgggaatcatgacaaattggaaagatttcctagaggaggaattacaggaaaccaggatggcatttcaaaaatacatcaattatacctttcctaagctttcaccaggacatgcagattttattctgccagaaagaaagaaaacaccttctaatcttgttattaaggagaacaaaacaactcttgattagaagtcttcagttgaaattccactacaaaagacatcattccagactaaataaatttactcaaaaacca

SEQ ID NO: 8578 - DNA, 2110 bp, Homo sapiens
  ENST00000608326
tatttctacacaatgttgggcttttgcagtatgtgtccatctccaccgtaatatatgctgccctgtgtttttaagattcgctgatgaactagtaggagactctgtgccgccaaacatatacttttaattgctagtgacagaaacataactcagaatagactgcatgaaatggaatttcttgactcttttaacagagaaacccaagggaaatctggcatcaaggctttcaatctgtccatgcttacccttttagtgagttggcttaatggtttactgctgcagctagacttactccggcagctgggaaaggaggaatgtggatccagatagctctaagaatctattaccttcagcttagaaatcccagaggaagaccaggcatggtggctcacgcctgtaatcctagcactttgggaggccgaagtgggcagatcacttgaggtcaagagttcgagaccagcctgaccaacatggtgaaagcccgtttctactaaaaatacaaaaattagtcaggcatggtggtgggcgcctgtaattccagctactcgggaggctgaggcaggagaatcacttgaaacgggaggcggaggttgcagtgagccgaaatggcgacactgcactgcaggctgggctacaaagcaagactccctctcaaaaaaaaagagaaatcccagtggaaaaagacctggctgtctgatattgcgtggtcctctagcctctctagacttttattaccttgtctgggtagagaggatattattatgggaatgttattatttggaaatcaaattagatcattgacagaaaaatagtaaacttctaccccttagctcactccatactgaagcagttaaacccacaaagaaccacatgctaaagaaaggcatgtaatgtgaaggcattccacttcccttctcctgatgctagccctagcacccaaataggaacagggagagagagagctgtataatgtgctaagacctcttgaatattcactcatcattctactttgggtgtacaaaatatgtccctttcttcgggcatttatttcacctccccagttgtctgctgtgtggactgggtgtgatgaggggaatgaccaactctatccaggcctgacagtgctgtgaattccctcctaatcagagaaaatcttactctttcaatgggtatctttgaaatatatatactggcatctcctaaaaggacgtgtctcctaaatagccctcataaataactagataatggtggaaaggaaagccaggaagcagtcggtggaggtttgtgaccattgctcttcaaatacacagatattggggcaaatattctgaaaaaagaagagcagtttcaagaagatatactcagagaacacattgcgaaagcagaagctgaagtatgggctcaggaagtgacagctaaaactaagacagagatgtatcaaaacatggatgacgaaatgaagagagagcacttggctgcagaacagcgcatggtccacagaatccaaaggattatgatggaatgccacagagagaaggtcgaagctgtggagaaagccagggctgaagaaagacacatcgcccaggaagcaatccaggcccagaaaagcaaagccgtggaggaaattgtgaatactggtgtcacagttattaaggatgagaagaccagtgtggcccgactgatgagggaaaaagaacatgaaatgagcatcctctatggcatagctcagaggcagaggcaagaagaggtacaggaagtgcttcaagaagcagagaaaacacatcaggccactcttggcaatatgatggataaactggctaacacccagggggagctgctgtctatagcaaaacaactgggaatcatgacaaattggaaagatttcctagaggaggaattacaggaaaccaggatggcatttcaaaaatacatcaattatacctttcctaagctttcaccaggacatgcagattttattctgccagaaagaaagaaaacaccttctaatcttgttattaaggagaacaaaacaactcttgattagaagtcttcagttgaaattccactacaaaagacatcattccagactaaataaatttactcaaaaacc

SEQ ID NO: 8579 - DNA, 718 bp, Homo sapiens
  ENST00000369574
aagttttccatatcatacacactcttcttttaaatcatcagtgttaacaggtacacttgctagcagatagataaaactatggtttaaatagcctcctaatgtgcagttttaaacattaagtctgtaatagctaaacctagttttgccattgcttcaggaagtgacagctaaaactaagacagagatgtatcaaaacatggatgacgaaatgaagagagagcacttggctgcagaacagcgcatggtccacagaatccaaaggattatgatggaatgccacagagagaaggtcgaagctgtggagaaagccagggctgaagaaagacacatcgcccaggaagcaatccaggcccagaaaagcaaagccgtggaggaaattgtgaatactggtgtcacagttattaaggatgagaagaccagtgtggcccgactgatgagggaaaaagaacatgaaatgagcatcctctatggcatagctcagaggcagaggcaagaagaggtacaggaagtgcttcaagaagcagagaaaacacatcaggccactcttggcaatatgatggataaactggctaacacccagggggagctgctgtctatagcaaaacaactgggaatcatgacaaattggaaagatttcctagaggaggaattacaggaaaccaggatggcatttcaaaaatacatcaattatacctttcctaagctttcaccaggacat

SEQ ID NO: 8580 - DNA, 612 bp, Homo sapiens
  ENST00000608891
gctgcccccaacaagcaaggctggatggactggtacaaatagcacataggtgctgcaagagttcaaagtcctggaaagatcaagcagtatgggtggggtatgtagtgagcaaagccgtggaggaaattgtgaatactggtgtcacagttattaaggatgagaagaccagtgtggcccgactgatgagggaaaaagaacatgaaatgagcatcctctatggcatagctcagaggcagaggcaagaagaggtacaggaagtgcttcaagaagcagagaaaacacatcaggccactcttggcaatatgatggataaactggctaacacccagggggagctgctgtctatagcaaaacaactgggaatcatgacaaattggaaagatttcctagaggaggaattacaggaaaccaggatggcatttcaaaaatacatcaattatacctttcctaagctttcaccaggacatgcagattttattctgccagaaagaaagaaaacaccttctaatcttgttattaaggagaacaaaacaactcttgattagaagtcttcagttgaaattccactacaaaagacatcattccagactaaataaatttactcaaaaacca

SEQ ID NO: 8581 - DNA, 2968 bp, Homo sapiens
  ENST00000402696
gggctttgcctgtcattctgcagttctagtgtggggtctgggcgcagttcttttccctctccagcctcggagtcttcctctgtggactgcgcagataggactggtggcacggaccagctctgcagccctggagtcaggagcagagccccccggctcccagcccgccgtagccgctcctggcaccgagcgagccgcgatgacaatggctgcattgtgcttcatgtcccttcccatcaacatttctgtgctggactccttccactcgcgggtcgtctccagagctcagaaaatgaggtgatcagtgggacgagtaaggaaggggggttgggagaggggcgattgggcaacccggctgcacaaacacgggaggtcaaagattgcgcccagcccgcccaggccgggaatggaataaagggacgcggggcgccggaggctgcacagaagcgagtccgactgtgctcgctgctcagcgccgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctatagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaaactccattctttcctaaatattttcaacaaaggatttctttatgcattctgcctaaatacctatgcaactgagcccttccttctcagctcaagattcgtctggtctttccctacagctttgtgtgtgccatggccacatctcctgggtacagttcaaggagacatcttttctaaaagggtctgcgtgatcattaaaatataatcaaatgta

SEQ ID NO: 8582 - DNA, 526 bp, Homo sapiens
  ENST00000466911
gactgcgcagataggactggtggcacggaccagctctgcagccctggagtcaggagcagagccccccggctcccagcccgccgtagccgctcctggcaccgagcgagccgcgatgacaatggctgcattgtgcttcatgtcccttcccatcaacatttctgtgctggactccttccactcgcgggtcgtctccagagctcagaaaatgagggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggt

SEQ ID NO: 8583 - DNA, 645 bp, Homo sapiens
  ENST00000474287
aaagattgcgcccagcccgcccaggccgggaatggaataaagggacgcggggcgccggaggctgcacagaagcgagtccgactgtgctcgctgctcagcgccgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagagggtaagttctccctgggaccccaggaaggagttgtcatccttattctatatgctgagtgctgtgttttacaggcaggttttggatatcagatataatgaacattcatctttggagagtgagtagagaatgaggggccctgtcagctgccacagccacacatcaaggcctctgggggctttgggctggctgaggactggtgctcctaaa

SEQ ID NO: 8584 - DNA, 577 bp, Homo sapiens
  ENST00000460531
acagaagcgagtccgactgtgctcgctgctcagcgccgcacccggaagatgaggctcgccgtgggagccctgctggtctgcgccgtcctgggcaaacgaagcggatgctgtgacactggatgcaggtttggtgtatgatgcttacctggctcccaataacctgaagcctgtggtggcagagttctatgggtcaaaagagggtaagttctccctgggaccccaggaaggagttgtcatccttattctatatgctgagtgctgtgttttacaggcaggttttggatatcagatataatgaacattcatctttggagagtgagtagagaatgaggggccctgtcagctgccacagccacacatcaaggcctctgggggctttgggctggctgaggactggtgctcctaaaactgagccctgggccaggggcatatgcttatcagagaaacacagcaggctgtgtgcagcttgacctgaaggctactgcggtctactgatatgtctagggtccctggaggcctctggagccataggtaccactcacacaggaggggtcactctggagcacacactcagagg

SEQ ID NO: 8585 - DNA, 546 bp, Homo sapiens
  ENST00000414694
acagaagcgagtccgactgtgctcgctgctcagcgccgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggtaagtcgctgctgcctaaaagagagtggaagaaagccatactttctctgtttccagtcactttggaacaattctttactcacaggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgcca

SEQ ID NO: 8586 - DNA, 594 bp, Homo sapiens
  ENST00000494430
acagaagcgagtccgactgtgctcgctgctcagcgccgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacgga

SEQ ID NO: 8587 - DNA, 999 bp, Homo sapiens
  ENST00000493011
acagaagcgagtccgactgtgctcgctgctcagcgccgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgagtgagatgtctgctgctccatggtggccaaagtgccaaatgtcctcagggtgagagttctttgctggtccaaagccgagccctgcctgcctacaggggcatcgaggtggcctaatcccctcccagtgagtcagaagcacaacctgggactcctaggccaagccagcccatgttccctttcatctgaccctgacaagtaggtccttttcctggggacccttcctttctccccagagccctcaagcctggtcagtgtctcctctcggtggatcgggcagagcctgaaaggacaatcatgcctctagtgtctggg

SEQ ID NO: 8588 - DNA, 659 bp, Homo sapiens
  ENST00000482271
acagaagcgagtccgactgtgctcgctgctcagcgccgcacccggaagatgaggctcgccgtgggagccctgctggtctgcgccgtcctgggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccact

SEQ ID NO: 8589 - DNA, 580 bp, Homo sapiens
  ENST00000485977
acagaagcgagtccgactgtgctcgctgctcagcgccgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatca

SEQ ID NO: 8590 - DNA, 586 bp, Homo sapiens
  ENST00000475382
attcatggggcatttgtcacactgttggggcttccacgtttagttttctctccccataagctagcaattccttgagagaggaccccacgttacttgcctttatccccgcacagagcacttcacaggctgtgcaagggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctct

SEQ ID NO: 8591 - DNA, 719 bp, Homo sapiens
  ENST00000498622
agattgtcatctccagctgggaggtgatggccatgcctgcacccctctggccagcagagggtggtcagtaggaaactgggaggccattagggcaaccttctattggctcagactcagaatgcagtagaacttgtgccctgtagtgttcatggacaggagtgagaggaggacaggactgaggggatgtggctgtcaaggcctttctaggggcgatgctgtctctccctcagcatagggagtgggcccttccacctctggcctctctcccccagggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaac

SEQ ID NO: 8592 - DNA, 990 bp, Homo sapiens
  ENST00000461695
ggtattttgctatagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactggggagacaatacagaaaagaagaggcaaaggggccgagatgggatacagacctgtatcacacaggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgatt

SEQ ID NO: 8593 - DNA, 582 bp, Homo sapiens
  ENST00000462495
aatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggtaagtgcacctgctcctctgtccccctagatcactagatcctggtcactggtattcacttgtattcagggatgcctttgtggaagtattatgtacactgtcagacttcaaagctctgattctcagtctgtctgctcagtgaagagagacatgttcacctgagtgcgcagaatgatcaggattatggggcccccaatggccctaaatcctccccaacacacactcccacagctgcaagccttgtgctcctttcccctaaatacttcagtgcctatttcctaagaataagacaatctcttgcatacccacagtatgattaccaagatcaggatcttttacattatgtggatttaatactcgtcacgtccacagtccacatttaac

SEQ ID NO: 8594 - DNA, 4602 bp, Homo sapiens
  ENST00000467842
gacaacatgatttttaagagccaaagtaattttgatgtattgtaagtttgggaactactggtctaatacccctgacttaatatcacattcctgataaatattactaaatgtaagtcacatcatgtctgattcatcatacttatattttgcaccttcttaccttcttctgttattaatttgttgctttttcaacttatattttagattgagggtacatatgcaggtttgttacatggtatactgcatgatgctgaggtttgcggtatgattgaacctgtcacccaggtagtgagcatagcacacaacaggtagcttttcaactcttgcccccctctctccctcctccaaaatctgtcttaagtgctatggtatatacaagaaggaagacacaaaaccacgtgggctttttttttttcttttttttctttttgagatggagtctcactttgttgctaggctggagtgcagtgatgtgatctcagctcactgcaaactccgcctcccagatttaagtgattctcctgcctcagcctcccaagtagctgggactacaggcgtgcaccaccacgaccagctaatttttgtatttttagtagagacggggtttcaccatgttggccaggatggtctccatctcttggcctcatgatccgcccacctcggcctctcaaaagtgctgggattacaggtgtgacccaccgcgctcagcccacatgggctcttttatcacaatttgtgtgtgtgtgtgtgtgtgtgtgtgtgtgtatgtgcatattataggtgtgtgtaggaaaaagaatgttagaaatgtaccaattttgaaggcgtagactatgaaattacaaatgcttcaaaattttcttcccaatacttacgtggcattttataaatttccaccaataaacgtgtattatttttattgaaaaagcatatttttaacatgcccttctagatgccctcctagccagactgaatcacctcccatttgatttttcttaattttctacctttaggttctggctcattcattaacatcaatttccattcataagtcctcacaaacccacttttcctcttgcctgagtgcctcacataccctactgcctgagatggttccagaggcggtctcctctctcccttagaaacaccaggcacacacctgcccccagtctcgcctgcactctcctttcctcccgcagagaggcattcctttctcctcctctcatcctacacacactataagagacaactgaaatcttgcctcctccagccagcttcttaattcatttgttctcaaagccctggtttgagctcacacagcatctagagtgttttacaaaatataaaatattattatccctgccctgaattttttgttttggtatgtgtgttattttcccctccaataagattgtgccttggagagggctgagaacatagtatcatagataaatgaataaaataacataaaataaaataaaaatacatataccctttgaactaactattccacttctatgtaagcacaattatatgccagtaacactcattttaacgctactttagtggcaaaaaattgtaaacacctcagatgcctattaaaagaggaatggtttaaagatactattatagccacactatgaaatataatacagtagttaagaagaacgagcttgatttgtatgtactgacaagaagaatctataaggtatgtaaacagttgaaaaaaaagctacagagttttacatttgtcaagatctaacactaaacaaaattagaaacatgtgaaatccatatacacacgtagaaaaatacatataatgagccgtggatggaaactcgcaaatgtgatattaaagactagcactataagactgagtgagatttggagagtataggaaaggaggcttttagttaatatagagagatattcaaaaatttatgagtgtgatctcatgtattagttattcggttaaagaaacaaaattaaatgaaaaatacatttttaaaaaggttgcaattctgaattatgggagagaaataaaaattagcaaaacatatttgcaaagtggctcaggaggaaggagctgaaaccctaagaatgggtgagttttttttttttttcagagacaatacagaaaagaagaggcaaaggggccgagatgggatacagacctgtatcacacaggtgtgtgcacattctcatttagaactggaacaagggagtcagatttaaaattctggtgcagattccaaaggtgttctctgaggaaaagttcttttgtttggagatgccatgtgttacagcacagaaattgatcaacctggcttagagcgtcacattcttcctctgttggagcaagaggtacagaaggaattggaatttagtggaattgaagatctttttgaacagcatctgcagaatgtagttcattctcacctggctgggtagggaaggttggaaggggatggtcaataatcattcctggtcactgtgagtctggcatcaccttgtagaccacatgggtgtctcttcctgtccacatcactgtaaccccagtgtgggcacttctgctggcgagaaggcccaggttctctacacaccactgagtcagttccatctccccagcggggcaccttgaccaaagccatcagctgaaccaccttcttcctgtccctaggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatgtgagtaggaggaacagcatggggaagtggcaaccaaacatggtggtgagtgctgggatggtgggtgggtacaggaggggtaggctgtggcccttgggataggacaacatggacaaaatgaaatggtgagtgaacaatctaagcccggcatgtatgacaggctagactgtaggggcagatagtaaggggatacaggctcagagcactaaggtagtgaacttattgggtatagagaattccatcttatttctaagaaaaggactgggtttatgtgtacatgccattgctctgcagtaaacttttgattagagttgccttgtccaatatggtagccaccagcaagatgtgactatttaaatttaagttaattaaaattaaactaaataaaagatgtatttcttcaatcccacctagctgcatttcaagtgctcaacagccacatgtggctccatattggtcagcaaagagaatgtttgcatcatcacagaaagctctttcagacagtgctgctctagacagcttcaacaatgataggttctggtaaccataaagttgctatgcatactactcatttggaacaccagtttctgagaactgaaatagaataaaacacatctttgcagtataactatgttgggtgtaactgagtcacctgaaaaagtttggaagctggggaataacatgtggtgtagggcagttagtctttccacaggagtatgcagataagggagtcttgatccttattaaaatgctgattctcagagccttgagatactgatttagaaagtctgtgctaggtcaggtatccgcatttgaaaagctgcccccatgtaattctgacggaagcagcaatgtgcttgtctaggttcgctattgtgagaatcaagttgatatttacctaacctatatcctccacaaaagcagacagtctggctctgctcttctttcctccatccttagcccacagcacagaaactggcacattgcaggtgctttttgctatgtcagttcctcacctgcttaaagaggtcagggaggacagtcttcctgggcgactcctggcctcaggaactcagatgtgtgagcctcgcccataagaaacaaggtggaggaccctgtagggcaggaaaatcatgttaacagctttggcgtggggcactccccaggataggcacaggagctgtgcaggcaagtagaaaagagcactgggagaacggcccagttcacagaagaggaggcagcaagtctgcacactttgtactatgctgaaattgttcaatcactcgacagttcagaaataaatataggaagattttgaaaatcctacctctctgctctgctccacagcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgatttt

SEQ ID NO: 8595 - DNA, 2968 bp, Homo sapiens; identical to SEQ ID NO: 8581
  ENST00000402696

SEQ ID NO: 8596 - DNA, 526 bp, Homo sapiens; identical to SEQ ID NO: 8582
  ENST00000466911

SEQ ID NO: 8597 - DNA, 645 bp, Homo sapiens; identical to SEQ ID NO: 8583
  ENST00000474287

SEQ ID NO: 8598 - DNA, 577 bp, Homo sapiens; identical to SEQ ID NO: 8584
  ENST00000460531

SEQ ID NO: 8599 - DNA, 546 bp, Homo sapiens; identical to SEQ ID NO: 8585
  ENST00000414694

SEQ ID NO: 8600 - DNA, 594 bp, Homo sapiens; identical to SEQ ID NO: 8586
  ENST00000494430

SEQ ID NO: 8601 - DNA, 999 bp, Homo sapiens; identical to SEQ ID NO: 8587
  ENST00000493011

SEQ ID NO: 8602 - DNA, 659 bp, Homo sapiens; identical to SEQ ID NO: 8588
  ENST00000482271

SEQ ID NO: 8603 - DNA, 580 bp, Homo sapiens; identical to SEQ ID NO: 8589
  ENST00000485977

SEQ ID NO: 8604 - DNA, 586 bp, Homo sapiens; identical to SEQ ID NO: 8590
  ENST00000475382

SEQ ID NO: 8605 - DNA, 719 bp, Homo sapiens; identical to SEQ ID NO: 8591
  ENST00000498622

SEQ ID NO: 8606 - DNA, 990 bp, Homo sapiens; identical to SEQ ID NO: 8592
  ENST00000461695

SEQ ID NO: 8607 - DNA, 582 bp, Homo sapiens; identical to SEQ ID NO: 8593
  ENST00000462495

SEQ ID NO: 8608 - DNA, 4602 bp, Homo sapiens; identical to SEQ ID NO: 8594
  ENST00000467842

SEQ ID NO: 8609 - DNA, 4378 bp, Homo sapiens
  ENST00000275364
ggcgacgagtgcgggcctcggagcgactgcagcggcggcggcggacgcggcctgaggcgagcggcggggcgtggggcggtgcctcggcccgggctcgccctcgccggcgggagcgtccatggcccccgggcgccggcggggcgcggccgcggcctgaggggccatgtccggggtggtgcggaccctcagccgctgcctgctgccggccgaggccggcggggcccgcgagcgcagggcgggcagcggcgcgcgcgacgcggagcgcgaggcccggaggcgtagccgcgacatcgacgcgctgctggcccgcgagcggcgcgcggtccggcgcctggtgaagatcctgctgctgggcgcgggcgagagcggcaagtccacgttcctcaagcagatgcgcatcatccacggccgcgagttcgaccagaaggcgctgctggagttccgcgacaccatcttcgacaacatcctcaagggctcaagggttcttgttgatgcacgagataagcttggcattccttggcagtattctgaaaatgagaagcatgggatgttcctgatggccttcgagaacaaggcggggctgcctgtggagccggccaccttccagctgtacgtcccggccctgagcgcactctggagggattctggcatcagggaggctttcagccggagaagcgagtttcagctgggggagtcggtgaagtacttcctggacaacttggaccggatcggccagctgaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgccccatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagacggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcagctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcgggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctcaaaataagatctgttcctcatagctatactgtgtacacataagacgcatatagggttttactgaaatctatttttaactcttatgttcgtagagaaattgtttcaaggattttgagtcataggtctgtaatttatagagatctctagaattcttattgtaattttcctacttctttgataaaagaaaaataagtcagattgttaactccaagattgaaaaaaaaaactcttgaaagaagattattagttgtaactaatttaggggttctgggcacagacatctaacctggtattgtaaggcagaggctcccattggaatggtagtggtccgggtcagttgttcatggtgtaagctttgcacagtgtattaacattgggagggtctggcttgaaaatttggccaccctcagcctctgaatgtttattaaaataaatttagtctttctttgcttaa

SEQ ID NO: 8610 - DNA, 3375 bp, Homo sapiens
  ENST00000491117
gtgtgtgtgtgtgtgtgttggggtgtcttgtgaagtcctgctaacctcttgtcagcagaatattcgagaaatgcttctgagaagagagaggaagatgacttcagaggctgcttgtggtctctcactcaaggctgggggagtcggtgaagtacttcctggacaacttggaccggatcggccagctgaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgccccatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagacggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcagctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcgggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctcaaaat

SEQ ID NO: 8611 - DNA, 3918 bp, Homo sapiens
  ENST00000407904
atttaagcagcctccttgactgtaggtccgctgactggcttcctccttgagagcacactcacagtgccggaccgcaggcacctcgccgatgttcctgtccacttgctttttgtattgctccttctccagtgagcttggaagcctcatgcgggcaaggccttgtctgtctggttctctgttgtgtcctcggagcctgccacagtggcggcgcttggtggctttgacaggggactggattgggtggaaggggcgagattagacctggatacagtgacgtccttgtcagccatgccgagtgcagagcgcctactgtattgtaggcatttgaaatgaaacggagaatgtttcccaggccgtgcctagcaaggatgcctggcagtcgtggttcgggaagcacaccagatggaaaccgaaagtgctgccgttttgagcacctactcattgcacaccctgggtccaggggctcaagggttcttgttgatgcacgagataagcttggcattccttggcagtattctgaaaatgagaagcatgggatgttcctgatggccttcgagaacaaggcggggctgcctgtggagccggccaccttccagctgtacgtcccggccctgagcgcactctggagggattctggcatcagggaggctttcagccggagaagcgagtttcagctgggggagtcggtgaagtacttcctggacaacttggaccggatcggccagctgaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgccccatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagacggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcagctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcgggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctcaaaat

SEQ ID NO: 8612 - DNA, 3785 bp, Homo sapiens
  ENST00000407653
aatgcttctgagaagagagaggaagatgacttcagaggctgcttgtggtctctcactcaaggctggtagggagccccggtctgcgtcctggaggaacggcacgctgagtcctgggccagtggccggcggggctgttggcgaccacagtagcacacaagggctctttctgaggagcaggagaccctggcacgggccccacgggagtgtctggggcgtccccgcctgtggcctcttctccccgccgcagcaccaatggctccacgagcagggctcggagctggccctctcctgcttcggagccgcgctgactgggtgtgtggcggatgggaggccgccctgagtgctcctcctcccttttgtacagcctgggtggaaaggacgggcctggtgcacttcctgcgggagggaggacatggggcctgcttccctctggcgctcctccacccgggcagcgtggtttctttccaaatgatttatcctctcatcgtcctgccgctctgtgcttcatggcattggggtcttatccggaaggggattgtccttttttggggggagtcggtgaagtacttcctggacaacttggaccggatcggccagctgaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgccccatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagacggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcagctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcgggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctc

SEQ ID NO: 8613 - DNA, 2450 bp, Homo sapiens
  ENST00000496740
tttgtgccgtcagcaagccgggctgtgtctcagcctcacagcactcctcccacgggcctgggaaggcaaatgtgttttctgaactgtgttgagaccgtgtgtgtgtgtgtgtgtgtgtgtgtgtgtgtgtgtgtgttggggtgtcttgtgaagtcctgctaacctcttgtcagcagaatattcgagaaatgcttctgagaagagagaggaagatgacttcagaggctgcttgtggtctctcactcaagtgaggaaagtgggaaccgccataccgtgtctggattcggtgggatcgtgtgtgtccagcagcagtcgcgcagcgcctggcgtgagtggtgggtgcacgccggccccgccatgtgcaccttctgtgacgaccctaagtcagggtggtgtttcctagcagtgcagaacacgaagcccttacaacttctcctagaaacgaagcctgggttgacccctccacctcaggggggagtcggtgaagtacttcctggacaacttggaccggatcggccagctgaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgccccatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagacggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctgg

SEQ ID NO: 8614 - DNA, 1205 bp, Homo sapiens
  ENST00000471281
agggctcaagggttcttgttgatgcacgagataagcttggcattccttggcagtattctgaaaatgagaagcatgggatgttcctgatggccttcgagaacaaggcggggctgcctgtggagccggccaccttccagctgtacgtcccggccctgagcgcactctggagggattctggcatcagggaggctttcagccggagaagcgagtttcagctggtgagtgagtaggccttcttgctgggcacctgatagtgtgttttttacatgactattttggaccgttagttgaatttccttaaaaactgtgtaacagtccaagcaagctctaaatcaccgtaagttgtaatgatcaacaaccaaaacacgggatggaggcagatgctatataaaaggctcaagaggggaaggagcaagagccactcagggggagtcggtgaagtacttcctggacaacttggaccggatcggccagctgaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgag

SEQ ID NO: 8615 - DNA, 562 bp, Homo sapiens
  ENST00000485329
tgcttaccacagcgtccgggaaagaccactgacattgattgctttgatctcctgggtgattggcagtgagccagttcagatcctctgacttggtgtccccctggtgtactgggggagtcggtgaagtacttcctggacaacttggaccggatcggccagctgaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggagg

SEQ ID NO: 8616 - DNA, 559 bp, Homo sapiens
  ENST00000447791
tttaagcagcctccttgactgtaggtccgctgactggcttcctccttgagagcacactcacagtgccggaccgcaggcacctcgccgatgttcctgtccacttgctttttgtattgctccttctccagtgagcttggaagcctcatgcgggcaaggccttgtctgtctggttctctgttgtgtcctcggagcctgccacagtggcggcgcttggtggctttgacaggggactggattgggtggaaggggcgagattagacctggatacagtgacgtccttgtcagccatgccgagtgcagagcgcctactgtattgtaggcatttgaaatgaaacggagaatgtttcccaggccgtgcctagcaaggatgcctggcagtcgtggctcaagggttcttgttgatgcacgagataagcttggcattccttggcagtattctgaaaatgagaagcatgggatgttcctgatggccttcgagaacaaggcggggctgcctgtggagccggccaccttccagctgtacgtcccggccctgagcgcactctggagggattctggc

SEQ ID NO: 8617 - DNA, 6535 bp, Homo sapiens
  ENST00000334049
tcctacacccagctttccgtcctcggttactatcgcccaagatcaaagccaccctggttttctgattgccgcaactgcggctccaggtgctgagtgcacagccactgcggcactgtccgcagctgcgcgccgggctcagacggcattatttacggtacagaatactcgcccgcgcgacggtatttacggtaacggggaccagcctgggcggcagtatttacggtaacgaaagccagctgtatttacggtagcgagggctggaccggcggcggcatttacggtaacgggggccgggctcgcggaggcccgtcggttcggtccgctctgggcgttagcaagtgatctccagccaaggcggccgccaccccttgcacacagcagaaaatgcaaaatgaccctctggggcagtgaggggctgtggccctcggccccggcctgccgcacccccttcccgcagctggcggccggcagcgccgaacagggtccgggtgcagccccctcccgcccctccgctgaggcgccggcctgaactgggcgcgggaaccaggccgccctcggcgcccagcctgccctagtcccgcgcgccgcccccgctgtgccgcgcccacatgggtctgtgctacagtctgcggccgctgcttttcgggggcccaggggacgacccctgcgcggcctcggagccgccggtggaggacgcgcagcccgccccggccccggccctggccccagtccgggcggccgcaagggacacggcccggaccctgctccctcggggcggcgaagggagcccggcatgcgctcggcccaaagcagacaagccgaaggagaagcggcagcgcaccgagcagctgagtgccgaggagcgcgaggcggccaaggagcgcgaggcggtcaaggaggcgaggaaagtgagccggggcatcgaccgcatgctgcgcgaccagaagcgcgacctgcagcagacgcaccggctcctgctgctcggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggatgctgccgccaccctgcgacggagcggcgccccggactgcctgactgccagccccatgccatggtaggaggcagagtctctagttccatctcgctgccgtctgtcccgttctgtgtcgaccaccaagcctctggctacctctgtcccctcaggtttggttgtgtagcttctgttgtcattgaatacggcctcccgcagcatcccacccccaaaccaccgactctcattgccgacactgcagcagaatctctccgggtgggagccccattattcattctccctttattgattcatcgaggagaacttggtagatggggagaaaacacagttggtttttttttccacgttatcaaccgtgactgcaagagcgttcgtgcagtgccctgagccacggccgtctctgattctccctttatgaagctgcaggctgacgagagatggtcccttcccattggccttagcccaagacttggagtcgaccccaagcgacagagtgaccagaaacccttttacagtcacattcagagtcgctgctggcctcaggcatttgaattagagctactttgagcctcttaggcagaaaacctaccacattcactactgcaaaatgtgtcctgtctaaaaatgattctctaaactttccctatacttaggcatagtcttctttcttagattctctttgttgttgtccctattgctggtttattacactgtacagaccacaaaatgtaatattcttttgtataactactaaagaaaaatccttgtagatctttgtgccttcaccatggctatctatacctgtacatgaaatgtgtttgtattgtgctgaagagcttaatgtcaacattacctgctgcttactctgaaaaaaggaatgaatggtagctgtagaatttaggatattttatcaggttggcactttataaaatactccctgatttaaaaaattgtaagttatacacgttaatcatccacattctatcgacaatgtaccaacatcacaagctgttgcaaccacctgctgttacttctctgagctgtaaaaacctgaactcaattcaggggtacaaattgcaatctaatcttttcagggaaccagggatttttttctctctctctagacaatatgtttcctcattagtctgctaatgaaacacttcttcaagttccccaagtgggaacaggtccatcattcccttagtcaaaactttggacacaggctacgtcatacaagtaagcaaacagtaagagaaaaacaaaatgtggccaggcgcggtggctcacgcctgtaatcccagcactttgggaggccgaggcaggcggatcacgaggccaggagatcaagaccatcctggctaacatggcgaaaccctgtctctaccaaaaatacaaaaattagccaggcgtggtggcgggcacctgtaatctcagctactcgagaggctgaggcaggagaatctcttgaacctgggaggtggagattgcagtgagccgaggtcgtgccatcgcactccagcctggacatcaaagtgagactcaggccaaaaaaaaaaaaaaaaaaaaccttgacgtgtcaatgtttgtgtctggcctaggagaatgaggatgacagcttcacttgccttttgaagaagaaacattacaaaaccttaatctgaagtataaagtcaaaagatacggctctttctcacacttgcaagacttacaaatacagcctcaaacattatgacacaccaacaatatctagaaagtaagaactggtgtagcaatgatgcttcatattctagctgtagccacagagttgagggtagtttttgtaggtctaaaataataatctataaagatgtccaaagttaaattttcaacaatacaaatctagagaagtgacagcctacattacttcattattactcttcttttagtctttagtctttaatattttaaagtttactctataaatcagcattttgtaatcctttataaactcatccagatttaaatgctactttttcatgaagaaaggataactttatagacagtcagtgcaacacacacattttatctcatcaccgtcttactgcctccccatccactgtctcataaagccctcagctgaactaagataaataatacaatggaaattattttcagttccccttgcactgtcaaagtaaaacaagaaaactgaaaagctgcacccccagcaagaaagggaagtatgctgttgtatgcatcattactcaacaattaccctctaactaaacatcctgtttaagagtttaattcaaacaacagccagactgttaagaaaaaaaacaaaaagaataacttttatctggcttacaattattaaagcatttattttcaggtaccaaaagccatatcccattccactttttaagtttcttttgatcactgacaggcattaacagatgtagcaacgtggtctcctatagagaaaattacacttatctaaaaatctgattccattaattgatcaagtataaaaatctacgaaaacaatatgttctgcacatcacatctgtacttttttttttttaaatatattttttgagacggagtctcactctgttgcccaggctggagtgcagtggcatgatcttggctcactgcaacctccgcctcccgggctcaagggattctcctgcctcagcctcagctggtattataggcacttgctaccatgcttggctaatttttgtatttctagcggagacgaggtttcaccatgttggccaggctggtcttgaactcctgacctcaagtgatccacccgcctcagcctcccaaagtgctgggattacaggtgtgagccactgtgcccggccacatctgtacttttaagggtacagctttacagtacataggaatttgagaaccacttcacaggaagagggaaacagcccaatatttatttatgtatacacataatcccaagtgtgtgctggggccaccaggcccttcctgggggaacaaggactgtcgtgcatgtgagtgacgacattaatagcatttacatactgtacagatgcaacctttgatgatacatatatttgataaaaatgagaaaacagatttgttgtagagtacctgtccacttttatagcatgagaacagtacaatcaactatttattttgcagttactcatttcagtgattgagaatttctgtgctgtgcagagagacggcctgtaattggtctcatcatccacttgattctaacatgatctctgcccaaagttccatttcttgggctttgatatttataatggcgcctgctcttcatcttgtcttacgctttccgagcaagttcaaaccagaaagaaaaggtgaggctagaagcccaaagtgagtgagtgtgaggaccacaaggaagcccaccactccacagtagatgatcaaaaccacatcctcacgtgggaggtagcacttggagagggtgtagtctgtgggcgtgatgctaccctggaaaggagaagggaaagttatgctgagagcaccaggcacacgttgaacaccgcagtcttagaaacagcagagggaagactgccttctcaggtccccctcaggtgaggcagggaacgggccctcctcacctgagaccaagggggcccagccttctccctgcacagctcacccccgaccagcccaggctccagcaggagagacaagtaaggcccaagtgtgcctgagtggaaaatgtctgggacactgacctgtcaaaactggcccctggctcactgggttcccatcaaatatagtgggggatccataacagagattcagagaggcaccgtggagttccagggtcatcggtcagcgaggaacaaggagggaaaggtgtcttcctgccccttgatgctcaactaagcatctgttccctagaaatacatgtgtccaggtcgtctccatgggcttttctttgcagatacttttatgtggaacaacagtggcaaatgttttcatttactttgaatttgaaaatgttagggtttcctccacctttttatgaagtaaaagaacctgtcgtaccagcatcatgagctggatgcaggagcccatggctgaaaggagttaaaacgcccagtggtcattaagtgaaacatcttttatcaacctgcaaaagctgcagcgttctctgccaggtcaaatgggcatgtttagaaaataagagaagatggctgagtatagctaatgaataaatggttgtttctttagaaaattaaacacacacagagtgtaagaggagaggatacggccctccctgaaggataaagtccacctggacggtgccctgccctcgcttctcacattaactgcccaggaatgtcatgctgattggttcccggaagggtgtttggcaaggggcagtgtatggagctacgtgtagaaggagagaaatttgtgtgtggcttttgtaaattttgaccgattgcagcaattaaatagttgattactgtgttgatttaaatacttatgaaagctttcagacaaaaataaactttcacgttaccatgatgaaa

SEQ ID NO: 8618 - DNA, 471 bp, Homo sapiens
  ENST00000585590
gcggccgcaagggacacggcccggaccctgctccctcggggcggcgaagggagcccggcatgcgctcggcccaaagcagacaagccgaaggagaagcggcagcgcaccgagcagctgagtgccgaggagcgcgaggcggccaaggagcgcgaggcggtcaaggaggcgaggaaagtgagccggggcatcgaccgcatgctgcgcgaccagaagcgcgacctgcagcagacgcaccggctcctgctgctcggtacttcgggagcatctagagggcgtgatttggagtctgctagccaggaggccacaggagaaacacaggtcagccccagaatcatggagcacacatttgcctcgaccccagctgtattttcttttctgggaaaatatcagcccctggaattaggccagacacaggaatctgtagatacaaagctcgctagcagagcaagactcagaacgcaagagtggcac

SEQ ID NO: 8619 - DNA, 1285 bp, Homo sapiens
  ENST00000535121
agtctagaagctgagcagaacaaaggcggtgtgactgcaggaaagagaggagccgtcgcaggagccgcacacgtctccaactctctattgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtga

SEQ ID NO: 8620 - DNA, 1722 bp, Homo sapiens
  ENST00000269162
ggtgagcctcggagggatcctcctccctgctagaatatgcatgatcctccgcgagtcttcgcccgccaggagcagggacgcgtccgagccaacacggggcgcgcgcccagacgcactttcccggctcggggtgcaagagagccaggcggccgcggcgcagcggaggggctgcgggcccggaacccaggccggtcagcgtcaggaaagagaggagccgtcgcaggagccgcacacgtctccaactctctattgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggatgctgccgccaccctgcgacggagcggcgccccggactgcctgactgccagccccatgccatggtaggaggcagagtctctagttccatctcgctgccgtctgtcccgttctgtgtcgaccaccaagcctctggctacctctgtcccctcaggtttggttgtgtagcttctgttgtcattgaatacggcctcccgcagcatcccacccccaaaccaccgactctcattgccgacactgcagcagaatctctccgggtgggagccccattatt

SEQ ID NO: 8621 - DNA, 2255 bp, Homo sapiens
  ENST00000423027
gtctccagcggagaccggcgccctcgccccccgtctccgttcattgtgctgtattcatccagcagattttgaaacaattctcgtgtaaaaaggcattttactccgcgcgtcttccttacagccatttagttgggagtttgcggtgggcagggggagggagaagaaacgcctgctctgaatcggaaaacaccgaagagaccagaccatctctttcagcagcaggaaagagaggagccgtcgcaggagccgcacacgtctccaactctctattgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggatgctgccgccaccctgcgacggagcggcgccccggactgcctgactgccagccccatgccatggtaggaggcagagtctctagttccatctcgctgccgtctgtcccgttctgtgtcgaccaccaagcctctggctacctctgtcccctcaggtttggttgtgtagcttctgttgtcattgaatacggcctcccgcagcatcccacccccaaaccaccgactctcattgccgacactgcagcagaatctctccgggtgggagccccattattcattctccctttattgattcatcgaggagaacttggtagatggggagaaaacacagttggtttttttttccacgttatcaaccgtgactgcaagagcgttcgtgcagtgccctgagccacggccgtctctgattctccctttatgaagctgcaggctgacgagagatggtcccttcccattggccttagcccaagacttggagtcgaccccaagcgacagagtgaccagaaacccttttacagtcacattcagagtcgctgctggcctcaggcatttgaattagagctactttgagcctcttaggcagaaaacctaccacattcactactgcaaaatgtgtcctgtctaaaaatgattctctaaactttccctatacttaggcatagtcttctttcttagattctctttgttgttgtccctattgctggtttattacactgtacagaccacaaaatgtaatattcttttgtataactactaaagaaaaatccttgtagatctttgtgccttca

SEQ ID NO: 8622 - DNA, 623 bp, Homo sapiens
  ENST00000585642
agcgatatccggacacagatcacagcgttctttctgtttgtttgcaggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctaca

SEQ ID NO: 8623 - DNA, 477 bp, Homo sapiens
  ENST00000590972
caaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaataaaacccttgccctgagacatccagaagaaaatttttagtgggattaccacaaatgtttttgtgtgtaaaacctgtttttaaaatatctcagaaaatctacttacttgggtggagaactgcagtggcttcccattccttatctaacgtaaccctcagacttcc

SEQ ID NO: 8624 - DNA, 585 bp, Homo sapiens
  ENST00000590228
ggaaatttaaaatcccactcaattgattggaatcagtgctaagagtaaattaagctaataacaactctctttcaatacagggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaac

SEQ ID NO: 8625 - DNA, 1038 bp, Homo sapiens
  ENST00000602628
aaaagagactgaaggggagactggacagactgcaaagggctggaggccacattaaaagtgtggactttaccccatgggaaggaggaagcgcaggagtcatgagaaatgatggttcaggcagagattagagcataaagcagggaggtggggaaagccaagaggaacacgctcttggatgacgagtcaccatgaatcactgatcacctgggacatggttcagctgcacatgctgacgcagtgggtctgccagtgacgccgatatgctgcgagtctgggaaccccttttaaggagcagggaatcttaactctggctgtgcattacaactgcctggtactttgtcaccaccttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggatgctgccgccaccctgcgacggagcggcgccccg

SEQ ID NO: 8626 - DNA, 451 bp, Homo sapiens
  ENST00000586926
gaacaaacaagatatgctggcagaaaaagtcttggcagggaaatcaaaaattgaagactatttcccagaatatgcaaattatactgttcctgaagacggagcaccaaggagaagcaccaccactggctgacagccaaggccacctgcccagccgcgggtgctgaagggcttccgtccaggggctgaggggaccctggcttgctgcctcggtgccaggcccagtgactgctcttcacccagcagcatgcgtcatctccatctgtgccctgcctctcccaagagactcacccatccctgagcatctgcagcacctgctggaagcctgggaccaccatcaactccaacgtcaactctcacttagcaattaaaaggaactaacagttggtccatgtgacggcatgggttaaactcacagtaattgtgctgacagaaagaatcaaagcaaaaacta

SEQ ID NO: 8627 - DNA, 3337 bp, Homo sapiens
  ENST00000262493
cagctggcggcccgcggagccgggtgcgcagagccgctggcgcactcgcgcgctgcgctggcctcctccccgccccgggcccaggcgcgcgcgcgcttgttcgctctcccattttttttttcccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctcctcctccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttgactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttccttttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtcatttctactttgactaatacccaaaccctaaacctcttcacggtttcacttttaagacttaatctttgctgaagaagaccagtcacagccatttcaaataaagaggaggcaaaaagacaaaacacacaaaaaattaaaaaaaaaaacttaaaaaaaaaaggaaaaaagaaaaaaaagcccacgggtctttgtaagcctttctattcccaatcggtgaggtttctgtgatatcttacacactgccagtctacttctctgactaatggaaaattcctgtgtagctcaataaaagagaatgtttgtctgtactcctgagtctca

SEQ ID NO: 8628 - DNA, 930 bp, Homo sapiens
  ENST00000569295
tctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctcctcctccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagtaagtccctgtggcattgggattcgtacttttattaagaataatttttaaatcgtttttattacattgcttactccaca

SEQ ID NO: 8629 - DNA, 3529 bp, Homo sapiens
  ENST00000638705
actccctccacatcccgcgccgccgccgccgcctcctccacctcctcctccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacacacacacacacacacacacacacaccactaacaaatgcaagttggtaaataaactttaaagaggcataacaaaaccttatatatatatatatatatacaaatatatatttaaaaaatctttttagtttgtactagaaagagctgcggacagaactgaccaccatcccatagctcatggaggttttcctgggacggcacgtgagcatgcacgtgtgtgtgtgtacacacactcacacatgtccagatgggagcttggtttgggagtccctccttttgaggatagccccggggtgttcctctcagccccatttctgagaacaggtgaatggcagaacagccctggccttggcccagccagctctctgtgttgcgcccttagagcctctgcgccctcagttccgtcctgctcttggcaaattccagaccctttcagaaatggccgaagccctaagcctctcctcactctgcactcccaaaaacagaacaatttaaggatgcttctctttcgggtggtggtggttgttaatttcaggaatttagaagaatcattgctccgaccaatccactgtctcctgagttttctttattcatgttaagatggcaagaatcagagaacagggagacttggtctgctttctaaaagcagctgacaggaggggactcaagttcacctgcagagttgaaaccagccccgctccaagagggcatgtgggaaggtggggagcgaggggaacaggcgtggcggggagggccggacttgtgggcctgacccgagtcagggtctcaggggggggccaggcttccccaggtgcccgggatgggcttcaatggggttcctgacccctcgtgctgctgccccatctcgcccaaccccagcagtagtcaaaatgttctagggttttttggttggttggttggtttttaaaatcaaagaaaatggtcagactggaccccttatctctctctctacagactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttccttttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcag

SEQ ID NO: 8630 - DNA, 5767 bp, Homo sapiens
  ENST00000262494
ccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgaatccctgaagctttttgacagcatctgcaacaacaaatggttcacagacacgtccatcatcctgtttcttaacaagaaggacatatttgaagagaagatcaagaagtccccgctcaccatctgctttcctgaatatacaggccccagcgccttcacagaagccgtggcttacatccaggcccagtacgagagcaagaacaagtcagcccacaaagagatctacacccacgtcacctgcgccacggacaccaacaacatccagtttgtctttgatgctgtgacggacgtcatcatcgccaaaaacctgcggggctgtggactctactgagcccagccgccctgcccggcacccttgccctgcctggcctgccgccccccctcccctggaaccaggctccaccactctcagaccactctttgcacttgaggaagaagacctcagaggctggcaccaagggagggaggagggagcatcctccacccgcaccccccaacagaacttgtggtaacgcaggggcggggcggggctgctgagtgcatgctgcaaggccaggagactccacgctcacagcctctgtgtcatctctgagtgcttgatcgggaagctggggggacagggcagggcccagatgggcacaccctgcacctgatgactcactggaagcctcggagtgtcctcctgtcatcttgggtggtgcaggggcgcagatggccctgcagcagggtgctggcagggtggggtcataggagccatccttcagctttgcctggggtctctggtggagggcagttccgtcaacaaaagccagggtgggatcaggccaacttggtgtgggttggaggactcaggccttggcgatggcctccgtctccctgctccctcccctgggtctcagcccttccttctctgggtcatcctcccttgcctttgctctcccagagaactcccatccctgactcctccgagttctggaaatgcttcttgagactgatttatggctcagatagatggtggcgtggagcggggggagggagagatgggaggtgcggggaagggaggtggaagctcctgtgtcacctgggctggggcctcccgcccagtcctcgcaggccaaagggtgacccatttcttttttccagtcaccaggagctcggatggtcactctgaggtgtgaatagatatgtttttccttcagtccacactgaattcaactcaaaccagcaaaggcctttgggctggggattctgtggttgcagaggtctagagggggtggacttttgcagccagtgcctccgcctcaccgtcttggtgaagaaatcagcgagtttgttcacagccgttggtgtcttcccagcccctggggacagaggacagcagggggatggagctgacaccctggagtatttggacccaggccagcacaaacacacccccctgtccccaactctaaagggagagtcctaggactccttagaggaggcttcactgcggagatccctgagcagaagggggcggggtagcttctcccggtgacggtgacgcaggtctggctggccttgggcaaccaacacacctctcccactccaagatgcctccaggtggctgaggccaacgcccacacccaggccagtcgtgtgcttgtacagcaggctgtgcctggggacctagatgtgccatgggagggaggagggtacccactgacaggcctctgcctccctcctcaagccctctgttctccctgcccccactctggacactgcttagtccccagccaggcagggcccctgggtttccacttgcagcccccggactgccccagagccgggaagcaccagtgccaacagctctggacttgttggacccacaggcacagagctctgagtggtgcccaggagacccaggaaccttccctagtgccaaatgcctgcagggaccggtgcctggggagcctctggcagccggactgcaggagccaccccatcagcccaagtccacctctgttttgttcacctcggtcatgttttggaccttgcaccaggtgctgggacgtggcagaggacaggccctgggaaccaacagtgtcctaccatggacagccagggccagctaagctaagccatcccgcccaacacagaagacatggcagttatttctcagcagcaccacgctgggtgaggccagttgttccgcttactctgctccgaactgtaaccccaggctcagaagcagccggcaaaagggggatgctggccacgccccacctctaaggccatcaccctggaggtggaagtcactgggctggagggctctccatgtcccccagcagccgccctcagaacacagtggccagagcaccaggctgggtccaggcctccaatccaggccttccctgtccctagaactggggctggaggagtgggtgctcagcccttcctgccctccatccccagcctgcctttctcttcctttggatgctccatcctccttggtttcttgcactgctctcaatcctcccaccctagcctgggggtggtccttggtcctcaggggtatccggggagaaattctctccctgtgcatgacacctgtcatccatgtcgtaaccagcggctccatcttgtggggtggtgactgagggtgacaaatgagatttggctccgtcgtggatgtggatgtgggaggaatgttgcgagtgacacgtgtgggtttctaatccacagtggtcctgcgtgtgccctgaggggccatggtaacctctccgatggctcggatttagcaggccaagcagaaactgatttctacgaagagcgtctttgccaaactcatgaaaattgtgcctgccactttcatgcctatgggccagttttgtgacctgcgccgctgaccatcctaagaaccaggtcttggccttccctctgagcactgatagaggtccccaaggctctctggcctgaggagggtgtggggtctgcccagccccaagcagagagcacagtctgggcccctgaccaacagctttggcattctgggttccatggggaccctagagctcaggcacaagaacaacaccatacctgctgccaggacgcagctgtctcccaggccctccccacagcccagctcccactggcaggaactggacacatccctgccctccatggtctgcactggtcttctctgagtattcttaggagcagaggcagccccaagttccaacttgcaagccctgtaactaagctgtctataaaccccagcagggaaggccaagggatggtctcacccatgcccttccctttggccaacatgagtcctgcagtggggagcttagcccctgctcccacctaacactctacagttagcacccaggggttgattcaggaagttcttcctttttctagcctgcatccttcctggccaccccctttatttctcagtctgacctggtgcactcttggcaagtgagtccattgcagtcccaggtggatatttaatgagcactcggactgtttcctccaagtcagctagtggcctgccctcctccttttcaagaagtctggggcacagagcctcctctggctgcctcttctcttctctgagcctctgggagccttcaggcaaaacctggcagttctcaggaacccagacctgaggctccagctccgcggccaccagagattcagtgtgcagtgccgaaggcagtcacccccaggcagttcctgctgtcaggccgcaagcctagagcgcaggatcccagcagcccagggaacagggccggcgtgtgagctgctgccgtggggtctgtggtagggctccccatctcccacccctcagcaagaagagtcctgacccctgaccccaccctgcccagagaggagctggggcctccagacagaccccactgcagccagatgaaggcccctgtcaaagaaggggcaggctgggggaaaagcagaaagaatggcccccagtccaaactcctggatcccctccatgagagaggggctccccctggaacagaagctctcatccccaggcccagtgcacaagaccaccagcagagacccaccgcccttcctggcagagcaccacttcctggcagtgcagctccgaggcaccactactgtcctccccttccctccccacccctcccctccctttccctcctctcccctcccctccacacctgccctgttactcccacagctctgggcagccaggccctcccctcctgcctcctggtcttctctactccgctggttctgacccatcccctggctctgcccgccgtcccccaccctgcccctgctgagtatcttcttcctccccacgcacccccctcccccatctaggcgaggtgggctcgggcgtcccaggccctccttagaaaagccgtctctctcgagtgcagtggtcccacctcccaaccccatcactgctgcccaccccatattaactgtaattttgtaagaagagtgacttgttggtttaataaatctctagttattgtaataatttattggctgccataatgtatttattagtcgcctaccgttaataaaaagtgcccgctttccta

SEQ ID NO: 8631 - DNA, 568 bp, Homo sapiens
  ENST00000570235
cttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaaatatccattgagcttctactctgtaccgagcaccatcttaagtgttgtaactgagcaagacacacaaaatctctgccctcctggagtgttctgacattcttgttaggggagacaggcaataaataaggaaaataca

SEQ ID NO: 8632 - DNA, 1351 bp, Homo sapiens
  ENST00000563661
cccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggtaggcccctgagcccataagcacagcaacaagaggttctgtctgtgttaccccactgcctcctctttatagtgctgggctgccttaaatgaacgagaagagactccgctatgtttgaaagatatatggtggcacagtcaccaacctaagccattgcatccacccctctggcaaactcccagcaaactcaccaactttgcaagttgcaggggctacaaaactcccggatttattttgcagatgaggaagagttggtgacagttctaaattggagctgccacaacactgtctaagtacctgtccttgggcaattaacttgtacagaaaaaaatatgtattaaacaaaacaagccttgtctggccaccatctcccctccttagaagaactttccttgccttgttgtggagtgaggatagccatttgaattgactgcctttcctcttttacaccaagggctatgttttctgcctcccctgggtaagtatgaggacctacagggctctccttcctgtagaaagtcagtgtcctagaacagggactgtttgggggtaacatttccagtcttctattaagtggtgaatggaataagtactatataaaagcctctaatttgcaaacatttatattaactgttaagactgaactatatacagctacactggcaaggctaaataaaaggagggagggagagagggagaggagaaaatagcctcagaattctttccagaagcagctctttgtccctgtttgggactgaatctcagtgatcctccctctgggacctggagattggagaagggggcggagggcaggtacagcctccaagcacctgggctctgcatctgagcctctggatggagagcattcatctctgattgctgtgtgatttgattgtctattatacacatgtcctgtctttgctaaaaatcatcttcctcacagaggaaaactgtc

SEQ ID NO: 8633 - DNA, 926 bp, Homo sapiens
  ENST00000639966
agggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatagtgagtgtcccagcgggcgcatggcctggagccgggcagtgatgcgggagtggaagggactggtgatggggattggcagagcaaggaggattctcggctgaggtcacgcctgccgggagatgttctcccataggtagagggtgtcaggaaggaatgagaaggggcctctcttcctgcaccccaggaggagaaagaggccagaggaggcagaggacgcaagagacaaccaaacagtggaaattcccagagggccgggaccttgtcactggcttgtcctggagagtgcctggcactgcaaaaagacagctttcaagtgtagcagctttgtttttttatagggagcccctgaccgcataaatacaaaccaaaacaacagccatataggcagaaaagaaatggtgccattttgttttattttagaaaaaataataagctttccattcccca

SEQ ID NO: 8634 - DNA, 2043 bp, Homo sapiens
  ENST00000640893
catgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaagctacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttgactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttccttttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtcatttctactttgactaatacccaaaccctaaacctcttcacggtttcacttttaagacttaatctttgctgaagaa

SEQ ID NO: 8635 - DNA, 1515 bp, Homo sapiens
  ENST00000639770
gccctcgagcggagcaaggcgattgagaaaaacctcaaagaggatggcatcagcgccgccaaagacgtgaaattactcctgctcggggctggagaatcaggaaaaagcaccattgtgaagcagatgaagcaatatgttctttctgtctggaagcttttaagattttgtgttcatcttgaagtttagcagttgtaccaaggatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttgactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgc

SEQ ID NO: 8636 - DNA, 847 bp, Homo sapiens
  ENST00000565363
tcgcatgccttagtccccccctccccctgttcccttaagctgacactcaccagtttttccccactgtctgtgtcccaacaggggctggagaatcaggaaaaagcaccattgtgaagcagatgaacccctcggggagtttaaataaggtgctgcggcacttgagttctgcaaaagacacctattcgctgaccagacaaagatgcttagccacaactcacaactctcagggtgcagttcgaagaggaggaagcagcatggcatataaagctcatgctcccttgaaggctggtgattgagacaagttatgtcttctagcatttgactccctcaaagagattgcaggacttccctctgattgcaggtggctcaatccactcagatcacctagaaacttgatagagatttagaatcttaaagaagacagaagcttagacagagcatgtagcccagcccatcaacagatgaagaagttgaatcctgcagggactacaaggaggatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccac

SEQ ID NO: 8637 - DNA, 1642 bp, Homo sapiens
  ENST00000638836
tttttccccactgtctgtgtcccaacaggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttgactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttct

SEQ ID NO: 8638 - DNA, 1065 bp, Homo sapiens
  ENST00000639251
actgtctgtgtcccaacaggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacacacacacacacacacacacaca

SEQ ID NO: 8639 - DNA, 3078 bp, Homo sapiens
  ENST00000640390
acactttctcaataaggagcctcgcccctcctttccacttgcaggctcgcttcttgccctatccactcggcagttcctggtgatcccacaggatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacacacacacacacacacacacacacaccactaacaaatgcaagttggtaaataaactttaaagaggcataacaaaaccttatatatatatatatatatacaaatatatatttaaaaaatctttttagtttgtactagaaagagctgcggacagaactgaccaccatcccatagctcatggaggttttcctgggacggcacgtgagcatgcacgtgtgtgtgtgtacacacactcacacatgtccagatgggagcttggtttgggagtccctccttttgaggatagccccggggtgttcctctcagccccatttctgagaacaggtgaatggcagaacagccctggccttggcccagccagctctctgtgttgcgcccttagagcctctgcgccctcagttccgtcctgctcttggcaaattccagaccctttcagaaatggccgaagccctaagcctctcctcactctgcactcccaaaaacagaacaatttaaggatgcttctctttcgggtggtggtggttgttaatttcaggaatttagaagaatcattgctccgaccaatccactgtctcctgagttttctttattcatgttaagatggcaagaatcagagaacagggagacttggtctgctttctaaaagcagctgacaggaggggactcaagttcacctgcagagttgaaaccagccccgctccaagagggcatgtgggaaggtggggagcgaggggaacaggcgtggcggggagggccggacttgtgggcctgacccgagtcagggtctcaggggggggccaggcttccccaggtgcccgggatgggcttcaatggggttcctgacccctcgtgctgctgccccatctcgcccaaccccagcagtagtcaaaatgttctagggttttttggttggttggttggtttttaaaatcaaagaaaatggtcagactggaccccttatctctctctctacagactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttccttttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtc

SEQ ID NO: 8640 - DNA, 2668 bp, Homo sapiens
  ENST00000638210
gcgccatgatggtagggagtagcgactcggagacaattttcccatctgcttgacatgttcttatttttattcgagagctccctggggctttcttcgcagagccccccttggctcgccgcacccttctgagccaggggtaatttagcttggggcttctcttgagcttgtgcaacccaaattgatggggaggcggggcctggggaattgccctttgcaacaaggtgcatgttgcatctgtctggagcccttgcagatctgtaaatgcaagccgcgccacccctttctcccgaggggggacgttttaaaacttcagaagtctgtaatcagcagtggcggactcggagcccagtagaagccccagccacctgagctggatgaggtttcaggcgttgcaagtggtggacagcgcccagccgaggccggaaaagtcgatggggctcagttcggcgacgctcggctaggatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttgactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttccttttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtcatttctactttgactaatacccaaaccctaaacctcttcacggtttcacttttaagacttaatctttgctgaagaagaccagtcacagccatttcaaataaagaggaggcaaaaagacaaaacacacaaaaaattaaaaaaaaaaacttaaaaaaaaaaggaaaaaagaaaaaaaagcccacgggtctttgtaagcctttctattcccaatcggtgaggtttctgtgatatcttacacact

SEQ ID NO: 8641 - DNA, 543 bp, Homo sapiens
  ENST00000563440
atattcccaccacagctggtttcaagctacccatctggccagtgagtgatgcaacgttagctcttgtgagccagcacaactcactccagcacaccactgggtcaggccatggaagatagaagcaagaaggactgaagagcattccatggctttgctctgagcacctgggtagatggggatgccgtctactgaggatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagccca

SEQ ID NO: 8642 - DNA, 1162 bp, Homo sapiens
  ENST00000638185
acagcccctcggggagtttaaataaggtgctgcggcacttgagttctgcaaaagacacctattcgctgaccagacaaagatgcttagccacaactcacaactctcagggtgcagttcgaagaggaggaagcagcatggcatataaagctcatgctcccttgaaggctggtgattgagacaagttatgtcttctagcatttgactccctcaaagagattgcaggacttccctctgattgcaggtggctcaatccactcagatcacctagaaacttgatagagatttagaatcttaaagaagacagaagcttagacagagcatgtagcccagcccatcaacagatgaagaagttgaatcctgcagggactacaaggaggatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaa

SEQ ID NO: 8643 - DNA, 1672 bp, Homo sapiens
  ENST00000639055
actccacagtcagtccttggttgttcagacctcctgttccttatggtgcttctggtttggtggcctggaacacccctgagcgtccctgagttttgggtggacatgaattcagaatctagcttgatctccctttgataccctggctttgcagtcataagaaatctagtaggtccccaccctgacacacacacacacacacacacacacataacacacacagggacacacacgtctgcctcctttagtgagtgctctggagagggacaggtctggtgcatctgtgtactcctgactcatgtagttatgtcccactttatccaagcactgtctggagctcaaccctatgccaggagatatgggaagaaagcagagataggtgagatgtggtgctttaattttaaaaattaaaaattagtaaacaagtcttctgggagatgatctctgattattattgttatcagggtacaaaatatgtaccttttagtcatgtctctgttggttctaagtggcagaagcccaaatcaaattagcttattcaaaattgagagggaattatttggctcatatcactcaaaagtatggggtgggcttcaggcatggttggacccaggggctcaaatgatgtttctgggacttgattctgcactcaatcgctcagctatgtagatgaacagcccacctggggctgctgcaatgtgagatgccactgactgttgctaaggtatctcgtggagcctcgctcctgatttccaaatcctggccttgtcacctccacaactcagacctgggctgtcacatgagactgaactctccagagctgtatctccaactccaacccagaggcctcctttccttgccagaacattgggcagatacaacagggatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaa

SEQ ID NO: 8644 - DNA, 829 bp, Homo sapiens
  ENST00000639268
gtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatagctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacacacacacacacacacacacacacaccactaacaaatgcaagttggtaaataa

SEQ ID NO: 8645 - DNA, 789 bp, Homo sapiens
  ENST00000562316
agtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacagactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactca

SEQ ID NO: 8646 - DNA, 968 bp, Homo sapiens
  ENST00000639341
gcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttgtttgtactagaaagagctgcggacagaactgaccaccatcccatagctcatggaggttttcctgggacggcacactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaa

SEQ ID NO: 8647 - DNA, 2620 bp, Homo sapiens
  ENST00000640560
gagcaaacccaggaaggaatagactgagaggagggtcctcatgcgaggaggactctcagaggcacttcctgggggtggctcaggtgcgccctcttagtaaaatgctcctcagatgcaagggcaggtctttgagtcatgatctgtgagcacagccagtcccaggacagactccaggggtagtgcctggggatggcagtgatccagctgtctgtcatcacctggagtgacaaggtcttctagtgagggcttttagcaaggctctgagcaccatggcccccatcctctgcctctcagcgtgctcacagcttaatccccaggcagccctcacctgcctggaccctgcgcctaccagctccctgcctcctacaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacacacacacacacacacacacacacaccactaacaaatgcaagttggtaaataaactttaaagaggcataacaaaaccttatatatatatatatatatacaaatatatatttaaaaaatctttttagtttgtactagaaagagctgcggacagaactgaccaccatcccatagctcatggaggttttcctgggacggcacgtgagcatgcacgtgtgtgtgtgtacacacactcacacatgtccagatgggagcttggtttgggagtccctccttttgaggatagccccggggtgttcctctcagccccatttctgagaacaggtgaatggcagaacagccctggccttggcccagccagctctctgtgttgcgcccttagagcctctgcgccctcagttccgtcctgctcttggcaaattccagaccctttcagaaatggccgaagccctaagcctctcctcactctgcactcccaaaaacagaacaatttaaggatgcttctctttcgggtggtggtggttgttaatttcaggaatttagaagaatcattgctccgaccaatccactgtctcctgagttttctttattcatgttaagatggcaagaatcagagaacagggagacttggtctgctttctaaaagcagctgacaggaggggactcaagttcacctgcagagttgaaaccagccccgctccaagagggcatgtgggaaggtggggagcgaggggaacaggcgtggcggggagggccggacttgtgggcctgacccgagtcagggtctcaggggggggccaggcttccccaggtgcccgggatgggcttcaatggggttcctgacccctcgtgctgctgccccatctcgcccaaccccagcagtagtcaaaatgttctagggttttttggttggttggttggtttttaaaatcaaagaaaatggtcagactggaccccttatctctctctctacagactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttccttttttttttttttcagtttttgtttttacttttgtcccgccgagtactatgtattacc

SEQ ID NO: 8648 - DNA, 382 bp, Homo sapiens
  ENST00000568375
aggccagcgatctgaacgcaagaagtggatccattgcttcgaggacgtcacggccatcattttctgtgtcgcgctcagcggctatgaccaggtgctccacgaagacgaaaccacggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacaca

SEQ ID NO: 8649 - DNA, 641 bp, Homo sapiens
  ENST00000640469
atccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttgtttgtactagaaagagctgcggacagaactgaccaccatcccatagctcatggaggttttcctgggacggcacgtgagcatgcacgtgtgtgtgtgtacacacactcacacatgtccagatgggagcttggtttgggagtccctccttttgaggatagccccggggtgttcctctcagccccat

SEQ ID NO: 8650 - DNA, 332 bp, Homo sapiens
  ENST00000564727
caggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccagactgcttcacggactctttgctgttgacg

SEQ ID NO: 8651 - DNA, 771 bp, Homo sapiens
  ENST00000639787
gcctgcagggccttatcttgccaaaccaaggccaaaaccagttctgagagaccctccaagcccggaagaaccgcatgcacgaatccctgaagctttttgacagcatctgcaacaacaaatggttcacagacacgtccatcatcctgtttcttaacaagaaggacatatttgaagagaagatcaagaagtccccgctcaccatctgctttcctgaatatacaggccccagcgccttcacagaagccgtggcttacatccaggcccagtacgagagcaagaacaagtcagcccacaaagagatctacacccacgtcacctgcgccacggacaccaacaacatccagtttgtctttgatgctgtgacggacgtcatcatcgccaaaaacctgcggggctgtggactctactgagcccagccgccctgcccggcacccttgccctgcctggcctgccgccccccctcccctggaaccaggctccaccactctcagaccactctttgcacttgaggaagaagacctcagaggctggcaccaagggagggaggagggagcatcctccacccgcaccccccaacagaacttgtggtaacgcaggggcggggcggggctgctgagtgcatgctgcaaggccaggagactccacgctcacagcctctgtgtcatctctgagtgcttgatcgggaagctggggggacagggcagggcccagatgggcacaccctgcacctgatgactcactggaagcctcggagtgtcctcctgtcatctt

SEQ ID NO: 8652 - DNA, 5062 bp, Homo sapiens
  ENST00000564798
ctcacccccgagacgctattccctggtgtctgcttccaactcgggattaattcgaggatctcttagtcctcagttaatgtttcccaactgaatgcgtgcacccttccaaccttgctgtcaaaaccgaatgagaccctggtagagaaatctgcatgagcagggttccgcgcagatgcgttcggtggtggttgcggcccctgcgctgtacgtgcatggtgcatgtcctctccgtgagctggagcctctccagtgacctcactgcccccacctggggccagctctctttggaagggggcagcatcccccaaccctgcccggccctgctccgccccgccctgcctgcgtgtggaatgaaacaggaccacgtcccgtctgtccttgtgggtcctcccgtctccgtcctggtggtctccgtcccggtggtgcatccagccacattggtggaccttccctttgcttgtcccgctgtgtcattggccgcggtgggtcagggccctggatgctgccgcccctcactcacccctccactctgttgcagaaccgcatgcacgaatccctgaagctttttgacagcatctgcaacaacaaatggttcacagacacgtccatcatcctgtttcttaacaagaaggacatatttgaagagaagatcaagaagtccccgctcaccatctgctttcctgaatatacaggccccagcgccttcacagaagccgtggcttacatccaggcccagtacgagagcaagaacaagtcagcccacaaagagatctacacccacgtcacctgcgccacggacaccaacaacatccagtttgtctttgatgctgtgacggacgtcatcatcgccaaaaacctgcggggctgtggactctactgagcccagccgccctgcccggcacccttgccctgcctggcctgccgccccccctcccctggaaccaggctccaccactctcagaccactctttgcacttgaggaagaagacctcagaggctggcaccaagggagggaggagggagcatcctccacccgcaccccccaacagaacttgtggtaacgcaggggcggggcggggctgctgagtgcatgctgcaaggccaggagactccacgctcacagcctctgtgtcatctctgagtgcttgatcgggaagctggggggacagggcagggcccagatgggcacaccctgcacctgatgactcactggaagcctcggagtgtcctcctgtcatcttgggtggtgcaggggcgcagatggccctgcagcagggtgctggcagggtggggtcataggagccatccttcagctttgcctggggtctctggtggagggcagttccgtcaacaaaagccagggtgggatcaggccaacttggtgtgggttggaggactcaggccttggcgatggcctccgtctccctgctccctcccctgggtctcagcccttccttctctgggtcatcctcccttgcctttgctctcccagagaactcccatccctgactcctccgagttctggaaatgcttcttgagactgatttatggctcagatagatggtggcgtggagcggggggagggagagatgggaggtgcggggaagggaggtggaagctcctgtgtcacctgggctggggcctcccgcccagtcctcgcaggccaaagggtgacccatttcttttttccagtcaccaggagctcggatggtcactctgaggtgtgaatagatatgtttttccttcagtccacactgaattcaactcaaaccagcaaaggcctttgggctggggattctgtggttgcagaggtctagagggggtggacttttgcagccagtgcctccgcctcaccgtcttggtgaagaaatcagcgagtttgttcacagccgttggtgtcttcccagcccctggggacagaggacagcagggggatggagctgacaccctggagtatttggacccaggccagcacaaacacacccccctgtccccaactctaaagggagagtcctaggactccttagaggaggcttcactgcggagatccctgagcagaagggggcggggtagcttctcccggtgacggtgacgcaggtctggctggccttgggcaaccaacacacctctcccactccaagatgcctccaggtggctgaggccaacgcccacacccaggccagtcgtgtgcttgtacagcaggctgtgcctggggacctagatgtgccatgggagggaggagggtacccactgacaggcctctgcctccctcctcaagccctctgttctccctgcccccactctggacactgcttagtccccagccaggcagggcccctgggtttccacttgcagcccccggactgccccagagccgggaagcaccagtgccaacagctctggacttgttggacccacaggcacagagctctgagtggtgcccaggagacccaggaaccttccctagtgccaaatgcctgcagggaccggtgcctggggagcctctggcagccggactgcaggagccaccccatcagcccaagtccacctctgttttgttcacctcggtcatgttttggaccttgcaccaggtgctgggacgtggcagaggacaggccctgggaaccaacagtgtcctaccatggacagccagggccagctaagctaagccatcccgcccaacacagaagacatggcagttatttctcagcagcaccacgctgggtgaggccagttgttccgcttactctgctccgaactgtaaccccaggctcagaagcagccggcaaaagggggatgctggccacgccccacctctaaggccatcaccctggaggtggaagtcactgggctggagggctctccatgtcccccagcagccgccctcagaacacagtggccagagcaccaggctgggtccaggcctccaatccaggccttccctgtccctagaactggggctggaggagtgggtgctcagcccttcctgccctccatccccagcctgcctttctcttcctttggatgctccatcctccttggtttcttgcactgctctcaatcctcccaccctagcctgggggtggtccttggtcctcaggggtatccggggagaaattctctccctgtgcatgacacctgtcatccatgtcgtaaccagcggctccatcttgtggggtggtgactgagggtgacaaatgagatttggctccgtcgtggatgtggatgtgggaggaatgttgcgagtgacacgtgtgggtttctaatccacagtggtcctgcgtgtgccctgaggggccatggtaacctctccgatggctcggatttagcaggccaagcagaaactgatttctacgaagagcgtctttgccaaactcatgaaaattgtgcctgccactttcatgcctatgggccagttttgtgacctgcgccgctgaccatcctaagaaccaggtcttggccttccctctgagcactgatagaggtccccaaggctctctggcctgaggagggtgtggggtctgcccagccccaagcagagagcacagtctgggcccctgaccaacagctttggcattctgggttccatggggaccctagagctcaggcacaagaacaacaccatacctgctgccaggacgcagctgtctcccaggccctccccacagcccagctcccactggcaggaactggacacatccctgccctccatggtctgcactggtcttctctgagtattcttaggagcagaggcagccccaagttccaacttgcaagccctgtaactaagctgtctataaaccccagcagggaaggccaagggatggtctcacccatgcccttccctttggccaacatgagtcctgcagtggggagcttagcccctgctcccacctaacactctacagttagcacccaggggttgattcaggaagttcttcctttttctagcctgcatccttcctggccaccccctttatttctcagtctgacctggtgcactcttggcaagtgagtccattgcagtcccaggtggatatttaatgagcactcggactgtttcctccaagtcagctagtggcctgccctcctccttttcaagaagtctggggcacagagcctcctctggctgcctcttctcttctctgagcctctgggagccttcaggcaaaacctggcagttctcaggaacccagacctgaggctccagctccgcggccaccagagattcagtgtgcagtgccgaaggcagtcacccccaggcagttcctgctgtcaggccgcaagcctagagcgcaggatcccagcagcccagggaacagggccggcgtgtgagctgctgccgtggggtctgtggtagggctccccatctcccacccctcagcaagaagagtcctgacccctgaccccaccctgcccagagaggagctggggcctccagacagaccccactgcagccagatgaaggcccctgtcaaagaaggggcaggctgggggaaaagcagaaagaatggcccccagtccaaactcctggatcccctccatgagagaggggctccccctggaacagaagctctcatccccaggcccagtgcacaagaccaccagcagagacccaccgcccttcctggcagagcaccacttcctggcagtgcagctccgaggcaccactactgtcctccccttccctccccacccctcccctccctttccctcctctcccctcccctccacacctgccctgttactcccacagctctgggcagccaggccctcccctcctgcctcctggtcttctctactccgctggttctgacccatcccctggctctgcccgccgtcccccaccctgcccctgctgagtatcttcttcctccccacgcacccccctcccccatctaggcgaggtgggctcgggcgtcccaggccctccttagaaaagccgtctctctcgagtgcagtggtcccacctcccaaccccatcactgctgcccaccccatattaactgtaattttgtaagaagagtgacttgttggtttaataaatctctagttattgtaa

SEQ ID NO: 8653 - DNA, 2869 bp, Homo sapiens
  ENST00000540458
gcgcctggagcctgtgatttgtcagggaaatctcagccacctgctcccctcatgcaaatgacccaagcccctggcagctgctccttaggcctccaagtgtaagccctgtcttccctctctgagctttgctgagacttagggccgcctgctttctctctgacccctgctttcacagcctcgagagggcaaggagggggccagaccccagcctgggagcagcgtgcgggccttccctccacttgaaatccgttgcccgcccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggtactgacaatggggccatctatcacccttatatcccacctcctggcctggttgctaagtggccctgactgccaagatcatcaccatggatgggggccgggaccaggggggccactggagctgtagttgtctgctcctttgcacccctcccaaaccccaacccttaatcctcacagctttgctctaatcctgtggggcctgatgctcttatctctgcctgcagagactgaccagggaagcaccccttcaccccctcctctctcagggcttgtggtgggggctgcccctctctatggccccacactcctgcccccaaccctcctcccggctgggcccaagtctctctggaatccgtacacctccctccctccccccaccccttccccccacccctgccagctgatttcatttgcctgacgttgtggttggctctacccttccctgtcaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagtaactccagagccctacccctggggccccagaaaacagctggggacatgaggagcgtggcccagggggagggggctgggtttgctcttgagtgactagaagtgaccagggactttctaaacttggttcgcatatttgagacccccaagccccagagccccaagaccaacctgccctgaaggcccatgcacctgccacccccacctcgcccttgctcccctgatgtctgctttccctgcaggatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggcatcctctctggccacgataacagggtgagctgcctgggagtcacagctgacgggatggctgtggccacaggttcctgggacagcttcctcaaaatctggaactgaggaggctggagaaagggaagtggaaggcagtgaacacactcagcagccccctgcccgaccccatctcattcaggtgttctcttctatattccgggtgccattcccactaagctttctcctttgagggcagtggggagcatgggactgtgcctttgggaggcagcatcagggacacaggggcaaagaactgccccatctcctcccatggccttccctccccacagtcctcacagcctctcccttaatgagcaaggacaacctgcccctccccagccctttgcaggcccagcagacttgagtctgaggccccaggccctaggattcctcccccagagccactacctttgtccaggcctgggtggtatagggcgtttggccctgtgactatggctctggcaccactagggtcctggccctcttcttattcatgctttctcctttttctacctttttttctctcctaagacacctgcaataaagtgtagcaccctggta

SEQ ID NO: 8654 - DNA, 1923 bp, Homo sapiens
  ENST00000229264
ccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggcatcctctctggccacgataacagggtgagctgcctgggagtcacagctgacgggatggctgtggccacaggttcctgggacagcttcctcaaaatctggaactgaggaggctggagaaagggaagtggaaggcagtgaacacactcagcagccccctgcccgaccccatctcattcaggtgttctcttctatattccgggtgccattcccactaagctttctcctttgagggcagtggggagcatgggactgtgcctttgggaggcagcatcagggacacaggggcaaagaactgccccatctcctcccatggccttccctccccacagtcctcacagcctctcccttaatgagcaaggacaacctgcccctccccagccctttgcaggcccagcagacttgagtctgaggccccaggccctaggattcctcccccagagccactacctttgtccaggcctgggtggtatagggcgtttggccctgtgactatggctctggcaccactagggtcctggccctcttcttattcatgctttctcctttttctacctttttttctctcctaagacacctgcaataaagtgtagcaccctggta

SEQ ID NO: 8655 - DNA, 761 bp, Homo sapiens
  ENST00000541257
tccccaccaccctgagctgaggagcacagtttgaggagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccactgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgt

SEQ ID NO: 8656 - DNA, 962 bp, Homo sapiens
  ENST00000541978
cttccccccacccctgccagctgatttcatttgcctgacgttgtggttggctctacccttccctgtcaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctg

SEQ ID NO: 8657 - DNA, 1110 bp, Homo sapiens
  ENST00000435982
agtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccactgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggcatcctctctggccacgataacagggtgagctgcctgggagtcacagctgacgggatggctgtggccacaggttcctgggacagcttcctcaaaatctggaactga

SEQ ID NO: 8658 - DNA, 590 bp, Homo sapiens
  ENST00000539127
cggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagcgggacctgctctgagccaggcaccatattggatgcgaaagatgcggacacggttcctattctcatccgtagaacaagagtgaccacagccccctcccagggccttgaagatgaagaagcgatagtactttctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgag

SEQ ID NO: 8659 - DNA, 616 bp, Homo sapiens
  ENST00000542868
ggagctggcctgggctctgctctcctgggctggggcgcaggcagggctcaggcaggctggggctggacgcaaaggacctcaaacttggagggcctagctggggagagggtgcagccacccagtcgtttccctgtgtcttggagtctggtgtgggcacgaagggcagaagcacagcctggtggggggttcctcaacaccgaccccatgttcctggcaggagccagagtgacccctcgacctgtcagccatgggggagatggagcaactgcgtcaggaagcggagcagctcaagaagcagattgcagtaactccagagccctacccctggggccccagaaaacagctggggacatgaggagcgtggcccagggggagggggctgggtttgctcttgagtgactagaagtgaccagggactttctaaacttggttcgcatatttgagacccccaagccccagagccccaagaccaacctgccctgaaggcccatgcacctgccacccccacctcgcccttgctcccctgatgtctgctttccctgcaggatgccaggaaagcctgtgctgacgttactctggcagagctggtgtctggcctagaggtggtgggacgagt

SEQ ID NO: 8660 - DNA, 796 bp, Homo sapiens
  ENST00000537035
ccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccaagctctgggatgtgcgagaggggacctgccgtcagactttcactggccacgagtcggacatcaacgccatctgtttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtggg

SEQ ID NO: 8661 - DNA, 997 bp, Homo sapiens
  ENST00000542751
cagcgctgtatagtgcagagcgggcgaggggcatagggaagtcactggcacgtggtatgtgttggcagggctgcttctcaccccaaaccaagggagggacaggcagggaggctgagagcagcggcttgccctggagctgtcaggtgggaggcagagggcgggagaggctgtgggctgcccaggtctgatccctgacccacttgccacccgtgccctcagttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggcatcctctctggccacgataacagggtgagctgcctgggagtcacagctgacgggatggctgtggccacaggttcctgggacagcttcctcaaaatctggaactgaggaggctggagaaagggaagtggaaggcagtgaacacactcagcagccccctgcccgaccccatctcattcaggtgttctcttctatattccgggtgccattcccactaagctttctcctttgagggcagtggggagcatgggactgtgcctttgggaggcagcatcagggacacaggggcaaagaactgccccatctcctcccatggccttccctccccacagtcctcacagcctctcccttaatgagcaaggacaacctgcccctccccagccctttgcaggcccagcagacttgagtctgaggccccaggccctaggattcctcccccagagccactacctttgtccaggcctgggtggtatagggcgtttggccctgtgactatggctctggcaccactagggtcctggccctcttcttattcatgctttctcctttttctacctttttt

SEQ ID NO: 8662 - DNA, 3055 bp, Homo sapiens
  ENST00000248564
gcgcggagaacacaaagtaaaacttctgctgttcccagtcctgcagccccagcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagcccgagcccggttctggggcgaaaatgcctgcccttcacatcgaagatttgccagagaaggaaaaactgaaaatggaagttgagcagcttcgcaaagaagtgaagttgcagagacaacaagtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgctttttaaggaaggaagaatgaaattaaaaggagactttcttaagcaccatatagatagggttatgtataaaagcatatgtgctactcatctttgctcactatgcagtcttttttaagagagcagagagtatcagatgtacaattatggaaataagaacattacttgagcatgacacttctttcagtatattgcttgatgcttcaaataaagttttgtcttgggaagatgagtgttggtgatttaagaagacacttttcatgcattaacttttatatttctccccgtaatcttttgggtgtggagtatgattgggtttggaatatgattcagaaggttaggtggttcgacagatcacatctccaaaccctgcgtcaatggtttagagtgctgagttctgacctctggaacgtgtttgatctaaccttaactattaagaaactgagcaggtagaattcctataacattgacagaagtcagattatctgagtcaggaacaaggccaagccacatctatgttagtacttccctagtttatcatcatttagatcttcttaatagtgttcctgtagtagtagccttgaagaaaatactgagttggggttcaggaagagtgccctgcctctctgccgtgtagtggccaggccagccctggctttgagagccagtacttattcctgcacagagctacatctcccatgtgctctccaggtcttgggcatggcactactccagttctgtggcattggtgcagacacttggacctctgcactcatgcttgccagcattttccagcaggcctgggccaaacatgcctttttttcttctcctccaaaggaaccagtgaatctttgcccactttaaagattagttggtctttttcttactgatttgtaggaattcttcatatattctggccatttattcgtgtttggtgatatgtgttgcgaataccttctcccagtctgtggcttaccttttcacagtgaccttcccttcagtggttttatcctgcagggcaacacgtcagagtataactcctgctcaagttcataacaaaggtacctgaagcccaaacctcacaaaaagggacctttctttctcaccttgagcattctcccgcttcttctccgtcttttgggtcaaaattgctccaagtttgagccaaaagaaaaacgtggaaaaacccttgctggttagctctagctcaaatggacttagtcattaacttgacctgcaattttcaatgtggcaccagaagccaatgtttctccttgactagctcttttctcccacttacacatgtaggtataccttactatcaagcgagagaggcgcctgtaacctgtagcagctttctaaagtatatcagcatcctcgttctgaaattcctttcctttccctctctgggaaagaacagaataccccaggcttttgaaaaatagtttacacagaccaaaagcagaaactatttccttcagtttcctgacactgtccaagtgatgacatcaattggcattactgagagcccagggataattttagcccaaaactactactcctaggaaggagtagtatgatctactactcttaggaaggatttaggaatagtaaaggtgtatttcttccaaacagcatagaactattagtactattagtcatttaacatttaacatggcatgggattttagagctttggtgcctgtaaagttttacttctattagctgtttcatttctttgcacttataaagttttcttctgttgcctatgaaagcaaacatttattccggttactggcaaggcagtttaaatcacctgcttctttcatgaaaggccaagacaatacatttattccctaacttgttgggagttgcgattacaagtctatatcctgatttctattagcacattcagctatccatttgtgtacactcccaagtcctagcttttgctcttcatgtctctttcaaccatatgatcaatcagttggacgacttctggtttttcctgaataaatatctaatcttataggtgcttctattaaatataattctgtttctttttcttaccatttatcattataacccagccaacatgtagaagtgcaataaaaatattttaattttcaactgttcaactgctaaaattattagcttgtaattaaaaaagaaaaaatacatccactatatatttagatatattgtaaatgtaacctttggtgactgataatttgttaagtagaatttaaattatgtatccaatttattcaaagtgtatagttgtgtaattatttactatttgattaaaaatagttatcatgca

SEQ ID NO: 8663 - DNA, 4404 bp, Homo sapiens
  ENST00000370982
agcgaggcggagccggcgcccggaggagcaagaggaggaggaggaggagaggtcggagccgtctccaggagcccttagagaccgagtcccggcggcgacggcggggcagcgcaccggcaggcggattcattccacttaaaacctgaaaacattggaccacacaaagtcttactgatttcaggtaaaaacaataattgaagatgtccagcaaaacagcaagcaccaacaatatagcccaggcaaggagaactgtgcagcagttaagattagaagcctccattgaaagaataaaggtttcgaaggcatcagcggacctcatgtcctactgtgaggaacatgccaggagtgaccctttgctgataggaataccaacttcagaaaaccctttcaaggataaaaaaacttgcatcatcttatagtggaatagagaaacagctcctcgcctcttcccaacaacgcaaattatgagcagctccttgaagagatttaccttcagcttatttggtaaccactgctaataactaaaatgttctcagcttggaataatggactctgaagtctctattttccaagttgtcctttctcttaaaataccctttactgatttaatacagaataacaatcttattttccacttggtaactatggctttatgttgggttactgtttaaggaaagttgatctgggcctttttaaaaacataattatatactttagaaatacaagggattccgatatgtcaggacctaaatggcctaagcacctgtcaaattaaaattccaaaattcattgaaatcctaaagccttgatattatattctttataaggcgtgtgccagcctgtatagtatataagagagaggggtgtttgtgtgtatatatatatgcctttgtgtatacacttatcaaagctattttcttatgaaaacgtccctctctccataccatcagtttctcagttccagaagttatacctttattttgagctgtgtataggtagaataaaaaattcctttcatatcgttattgtacaaaaagtaaagagtatcctaaagattgtattcattgtaatcaagtaatgcaatcatctctcctctcttgaaatcttgctggacctcttaggctacaataaactgtaccaaactaaactgacagtccttcgataatatgaaacattaatttacaaggacccgttagggcttcaatgatgctgagtctggaaaaggggaggagacccttgggaggactccaggcagctgtgctcccagggctcatgttctctactggattagggataggcacctctgaaatctccaccctgatgattggaatgaaacggagtgaacatgagcccagctgagagaggagcaggaatgtgtgaaaaacagctgctctccttgtcccagctttgtgattgagccctctgtcttgctctctctgccttccctgtgtctttcttctcttaccagagcatctgtttgcagaggtaacattaccttccccagccacaggtatgtggaatacggtgaggaaaaaaaaaattaaaaaaaaaatgcaagctgtcaggatgcttaagctcttttcagacatctgcagtttcatccctaccttgttcacataccatccaagaggcacataggctacccaagagagccttggattcagtggtacactccttgggcccaagggctttagcagctggatatggggttccttgattttcctctgggcccaaatatagccctcacactcttggaatttccaggtatgggggtagccccaaaaggaggaatctcctatggccaataaggtatcttgactttatcaaagtagaagagagggtcacttcggagtcaaatcatacactaggcctttgatgctttaattcttcttcagttcattaaaagtaactactaaggaaaggttaaaaacttcccctcaaaaaggaatcaaccccaggaagtaattatttacaacgattttcccaaattttgtacaatctgtcctggaaagcaaaccccttttaaaatctaatgtctgggctttgagtattagctcatttagggtggacaaatgcattactgttttcaaactgctcacatttattcagtatttctccaagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagtctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatagtggtaagaaatggacttgaggtcccaggagatttcattttattcaccctggtcagatacaataaaggctatgagtataaatacataacttcctaaccaggtgtagggcatgttcatgaatatcaaatcttttgatgctggacccaagagaggaaaagttgtagctaaatgttgatttacttataactagacgtctatgtgagaaaatatatgtatacatatatatgatatgcagaagtcactttttttatcaggctttattctccttacaaagccacagtttaactgtctgcaacagttggtttatgttaatgatagacaaatacccagtgtttgttactttttccaactaccactgtaatgataatctttctcacgtatatacatgcaacttcttggcttcatttccatgaagctgtttcaatatattcagtatactttgtccttaatgctgcttctgttaacagtgatctctttctttttttcattcttatatcttcattagttcatcataaatctgtccagttgaggcctcaggaccacggcatgatttcatgactccgaagtattttacagaaacattttttaaataagggaaatattttatataccagatggttcacaagtgatggctcatagctagtttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctgtactgcgtcagtgcctcattgtatcatcctacttgtgttttgctcaataaatgaataaaagaccatttctcttc

SEQ ID NO: 8664 - DNA, 463 bp, Homo sapiens
  ENST00000494936
gaggaggaggaggaggagaggtcggagccgtctccaggagcccttagagaccgagtcccggcggcgacggcggggcagcgcaccggcaggcggattcattccacttaaaacctgaaaacattggaccacacaaagtcttactggtaagttcttcatttcttaaacaaagtgactgtttgactttatttttgagatgatattcacacttctaagttagatgcttccctaccagtgctatgatgagatgtctatttatttgtacttttctttaatctctataatttatgatgtttccatgccttaaaaaaacagagcaacccatgttcctttgtaagaccatgggcaggataaagatccatgattacatgccaaatactactaaaataaaaacttttttgggtaatgaaactatttccaggcccctgttgatgggagtatccaaaacaacagagtgttatttcag

SEQ ID NO: 8665 - DNA, 984 bp, Homo sapiens
  ENST00000248150
cttggccctcgctctcactcgcggtcgcctggccgttgtcattgtccctccgctgtcaccttttcaagccccaggctggctgcttcagaagcccctgaccccatggaggagtgggacgtgccacagatgaagaaagaggtggagagcctcaagtaccagctggccttccagcgggagatggcgtccaagaccatccccgagctgctgaagtggatcgaggacgggatccccaaggaccccttcctgaaccccgacctgatgaagaacaacccatgggtggaaaagggcaaatgcaccatcctgtgagccccgcacccggcccctctcacaccatcctgtgagaccacgcccggccccactcccaccatcttgtaagactgtgcccagccccactcactccatcctgtgagtcccactcccagccccactcccaccatcctgtgagcccatgcccggccccactcacaccaacctgtgagccccactcccggccccactcactccatcttgtaagactatgcccagccccattcactccatcctgtgagtcccactcccagccccactcccaccatcctgtgagccccacttccagccccactcccaccatcctgtgagccccactcccagccccactcccaccatcctgtgagccccactcccggccccactcactccatcctgtgagccccactcccagccccactcacaccaacctgtgagccccactcccggccccactcacaacatcttgtaagactgtgcccggccccattcactccatcctgtgagaccacgcccggccccactcactctatcctgtgagaccacgcctggccccactcccaccatcctgtgagccccactcctggccccactcacaccatcctatgagcccacgcccggccccactcccaccatcctgtgaaccccactccactcgcacgtgattacagtctgtaaaggtgtgactttataaagaca

SEQ ID NO: 8666 - DNA, 577 bp, Homo sapiens
  ENST00000553432
agagcatgcagagccagcaagagcggatggctgaagaattacacgcagtggaaaagcagcaccgtggagctgggtgattcctgagcccaacctgtgcctctggtctaggggcatgcaggggaaattgcaacctccaatggaaagagaagcaagagatggtgtaccttcaggcaaagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccct

SEQ ID NO: 8667 - DNA, 522 bp, Homo sapiens
  ENST00000556522
atgcagagccagcaagagcggatggctgaagaattacacgcagtggaaaagcagcaccgtggagctgggtgattcctgagcccaacctgtgcctctggtctaggggcatgcaggggaaattgcaacctccaatggaaagagaagcaagagatggtgtaccttcaggcaaagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaag

SEQ ID NO: 8668 - DNA, 573 bp, Homo sapiens
  ENST00000557376
atgcagagccagcaagagcggatggctgaagaattacacgcagtggaaaagcagcaccgtggagctgggtgattcctgagcccaacctgtgcctctggtctaggggcatgcaggggaaattgcaacctccaatggaaagagaagcaagagatggtgtaccttcaggcaaagacaagaatcccagagcatagaaaagtcacacagctaattaagtgttggagcccggatttgaacccagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcat

SEQ ID NO: 8669 - DNA, 479 bp, Homo sapiens
  ENST00000553560
acaaacgcccgttggcatcaagacaggcctgtgaactggcatccccaggcaggctgcagactgggagggtgggagtgagcatgcagctgaccccaccatgaggcacagggcgtcgccttctcccctcagcacagaggagaggtgacgaatgccacttggtctctgcagcgtctgtagagggaagtctgtaagcgggagtgtcaaccccaattggcagattctctgacacttcaagtctgcaaaggaaaagcagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaagagcgccctctgctggtcagttctcagaaggcgccacatcatcgcgtctttcgtctgcagatgctctttg

SEQ ID NO: 8670 - DNA, 576 bp, Homo sapiens
  ENST00000554832
aggcaggctgcagactgggagggtgggagtgagcatgcagctgaccccaccatgaggcacagggcgtcgccttctcccctcagcacagaggagaggtgacgaatgccacttggtctctgcagcgtctgtagagggaagtctgtaagcgggagtgtcaaccccaattggcagattctctgacacttcaagtctgcaaaggaaaagcagccagatctgccagtgagcctcaggctttaggaactgaagagggatgatactgtgaagtgttcaggaatgaagtctcgtgatgtctgctacctagtttcaaatggcaggagagacagagggatggggaagcaaaagtgaccattgttaactctaggtggttggtaagtgggtgttccttgttttattctttcacctgtaatgtatgtttatgttttttaaaagttaataagttggaggatgatagaagcattaaaaagtaggccgggtatggtggctcatgcctgtaataccaacactttgggaaactgaggcagtaagctcccttggggccaggagtttgagaccagcacaggaaacatggcaagacct

SEQ ID NO: 8671 - DNA, 1542 bp, Homo sapiens
  ENST00000553299
ggcgtcgccttctcccctcagcacagaggagaggtgacgaatgccacttggtctctgcagcgtctgtagagggaagtctgtaagcgggagtgtcaaccccaattggcagattctctgacacttcaagtctgcaaaggaaaagcaggtacgactcctttatcttggacagtcatcttgtaatgcaggcctgtgggatacaaaggagaccagggaggttatgtgagctctgccaaatctattactactccaggggaaaataaaaccaaattcttgggctagtggaattactgtaggagaaatccagtatgattccatgtgaagaaccaatagcacccttaaattaaagccagatctgccagtgagcctcaggctttaggaactgaagaggtcataaaattgctgttatgtatgtgaaaacggccaaatataccatagaccccagattaggatcagtctggtgcctctgaaaatgtgaattgagaagaactgaaagaaaatctttccctggggagactgcagccgaaacacccttctgacgaatgtgctgacctaatctaagcctcaatttccttcaacaagggatgcatcgctcacttcccttgagttgtgagaatgaaacaagataatgcgttaaagcccttggcccagttcctggcatgtggcgagctcttggtccataagcaaatcttcgtattagttgtttctgaaagatctatccagcactccgatggccagcaacaacaccgccagcatagcacaagccaggaagctggtagagcagcttaagatggaagccaatatcgacaggataaaggaagttcactgacccctggtctacagcgatggttctcagctcatctgtgcgttcccaacacccagagagctctataaaaggaccaattaccgaaccacacccaaaccaattaaattagaatctcctggggtatgattcaggcatcagtattttttaaaaagaatttttcagttcattccgatgtatagccaaggttgagaaccactgtcctatgggaaggagtttacttctgctaagtctcatcaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaa

SEQ ID NO: 8672 - DNA, 3729 bp, Homo sapiens
  ENST00000335281
aacaaagggagaagggggattaaagtcaaatcactgtcagcagcccaggagcagacaaaaccaccagagtaagccctgaaatggaaatgagagggaaaagaagcaagccgctaacagctaccaagaagaggaggaagtgggagatgcgctgcttcctgtagaaagaacgttgattgaagacaaagctgggtggggactagtccctgggctgcagccgctgctacacatactcacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctgtgttctcttttcactattcctaacatgtgtacatgatagctttgattctgcaagtaaaagtaaatcctgtgttgtgactggtgctttcatatatttgtgacaatttttgagtaatattgcatgaaaatgtccctatgttacatccattcagaagttttgttgttttactctaaagctgggaaaggaaatgagagggaaaagaccccggagagggaagaaaatctcagtattttgaaaattgagattacttcagagccttagccacacctaaaatacctcctagttaatagtggtataaatgcctcttcaatacgttttccagaatccaaagcattttggtttatccaggacccagggcagcacagctgtcaccaagcaggagagttaaggattcaccatgagctgggaaatgcttttgccatgagtatgagcaaattccctctttccctgaatcatggacattctagattaaaagaacatttttttgtgctcttaacaagaaaaccatggccctcctttgttcaagtatcagaagaaataaacccacagctccagagaaggtgaccattctcagaactccagctattcactctccagggagaaggacctcaaatcgccactctttgggcggcaggtgcggtccccacggccggctctacgaggaagagttctggctcttttgtccactgagatggtcttggtttttcacttaacaaattttttaatggaatctttgtttttgttctccatcttgtttgttagagtctctcggcctttatttacaaattccttgcaactagagcgctccttccccaagatatggtagtgagagtaatttttcattgtagctgtagtctccatcagtaacagcaggccctggaagacttgatcacctttttctgtgtcattttcagtcaaagagggcctctcttacatcttgtttgctttcaaatccccaaatatcatctccatctcccaattaattttattgtctctttcctctctattcgctttctcctgttttttttttaaaaaaaaagcatgaaaaaggaagagaaaaagtttgatatgccaaggacagattttgaaacagacttggtaaatgttttccttagctccttcatgggcatgctggtgaaagaataaatacatccaattaaagctcatgctggggtcggggagaagaggatactgaaacatttgtgaaatgtatgaatgcacttctgtaaccagatacttctgttcttctgttcaaattgtggggtttttgttacagttaggacgcccatgaagatttaggggtgaaaaaaacagcagagtatttattaaactacagcattgtacaattagcttagtaacactatggaataagctaaaacatatcacagtttttacatgggccaaaacatgaattgagtatgtggtcacatgaaaacacggatgaatgaataaaacactctttggtggtgactgaggcatcattagaaggcccagacgatttccactattcacagcatttccttttctcagaaggactctttatatttccatgtaaatctagatctttggagcaattaagatggaattacaatttctagggagcattttaaggaaaatgttttggctttttcataattttatgtcttacagtatggaattataatacgaaaatctttatatgagttttggcttcttggtatttgtacttattcaggggaaaaagtctttcgattacttatgcctctatagagcttaatttcttgagaaattcaacagtcattttcaccagcataattttatcttaaggaataactaataggaaaagtcagcttaattatttaaggccctagtttctacatataatatattcgatagaaatgaaaatctgccgtggaattaactaataagtagtaacaataaacttcatatttagaatgcaaagtctataaagaataattttacatgatcctcaatatcaactccagtttaaaaagtgttatttttaaaacatttgaaaccaagtactgtttaatttcaatcagaagatgcaaatacatactttgatctatgtttgattttgctaataatatttgaaggagattgcctaccaaggacaaaacaataaatttaaaaatcaaacgatttctccatacgctcatagtcacatatggaattttgagaaaataaagcatgctgtctttaggaatttttatacttctttgtctttcttccttaatatttgcttctagctgctcttggcaatgatgaattgttatgtatgcattaatgttttgcagcccaaaagttgttcacatttttcctatataagatctgtggagtgtgtgtttcaaagagagaactacagaaatgttaaagcaggaaaacctgaatgtgatgtgcacattttcatcccacatggacaatgtatgtgttttaataaatggaattttcagattc

SEQ ID NO: 8673 - DNA, 578 bp, Homo sapiens
  ENST00000557208
tactcacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagccagatctgccagtgagcctcaggctttaggaactgaagaggtaagaattccaaaatattttcttctagaatcttgaatttaaccagaacttaaagaggaaaaaaaatgttaagtggtctatagatgaaagcatgtgatgttttattgaaagaaacagtcatagagtccttatcaatattgacatgacttcagaatttaaagaaaaaatggctgtctttaatgatagttaaaattgattttcatccagaattttttcattttcttctaaaaacctgagttggagagcctttgaggctgctgtcttaacagaatgtatcctcacggcacaaacatgattaataggtggcagacattgagggcataccctgtgcaagataaagcctcagatgaggctgattaggtcagggaaaggtaaaccctgttctta

SEQ ID NO: 8674 - DNA, 908 bp, Homo sapiens
  ENST00000555472
actcacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagccagatctgccagtgagcctcaggctttaggaactgaagagggatgatactgtgaagtgttcaggaatgaagtctcgtgatgtctgctacctagtttcaaatggcaggagagacagagggatggggaagcaaaagtgaccattgttaactctaggtggttgtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaa

SEQ ID NO: 8675 - DNA, 2125 bp, Homo sapiens
  ENST00000556766
acaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctgtgttctcttttcactattcctaacatgtgtacatgatagctttgattctgcaagtaaaagtaaatcctgtgttgtgactggtgctttcatatatttgtgacaatttttgagtaatattgcatgaaaatgtccctatgttacatccattcagaagttttgttgttttactctaaagctgggaaaggaaatgagagggaaaagaccccggagagggaagaaaatctcagtattttgaaaattgagattacttcagagccttagccacacctaaaatacctcctagttaatagtggtataaatgcctcttcaatacgttttccagaatccaaagcattttggtttatccaggacccagggcagcacagctgtcaccaagcaggagagttaaggattcaccatgagctgggaaatgcttttgccatgagtatgagcaaattccctctttccctgaatcatggacattctagattaaaagaacatttttttgtgctcttaacaagaaaaccatggccctcctttgttcaagtatcagaagaaataaacccacagctccagagaaggtgaccattctcagaactccagctattcactctccagggagaaggacctcaaatcgccactctttgggcggcaggtgcggtccccacggccggctctacgaggaagagttctggctcttttgtccactgagatggtcttggtttttcacttaacaaattttttaatggaatctttgtttttgttctccatcttgtttgttagagtctctcggcctttatttacaaattccttgcaactagagcgctccttccccaagatatggtagtgagagtaatttttcattgtagctgtagtctccatcagtaacagcaggccctggaagacttgatcacctttttctgtgtcattttcagtcaaagagggcctctcttacatcttgtttgctttcaaatccccaaatatcatctccatctcccaattaattttattgtctctttcctctctattcgctttctcctgttttttttttaaaaaaaaagcatg

SEQ ID NO: 8676 - DNA, 549 bp, Homo sapiens
  ENST00000554840
agatcagctccggagaggggaaaaccacgctcctcggaccaagcctcgggagctaagccagatctgccagtgagcctcaggctttaggaactgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttcttt

SEQ ID NO: 8677 - DNA, 569 bp, Homo sapiens
  ENST00000554736
agtgtcttcctccctcagcttgtgcagctgctttcaggataacctcagacacagctatcatttgccaccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcc

SEQ ID NO: 8678 - DNA, 3424 bp, Homo sapiens
  ENST00000556752
gtttttctctctgctttctcaacagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctgtgttctcttttcactattcctaacatgtgtacatgatagctttgattctgcaagtaaaagtaaatcctgtgttgtgactggtgctttcatatatttgtgacaatttttgagtaatattgcatgaaaatgtccctatgttacatccattcagaagttttgttgttttactctaaagctgggaaaggaaatgagagggaaaagaccccggagagggaagaaaatctcagtattttgaaaattgagattacttcagagccttagccacacctaaaatacctcctagttaatagtggtataaatgcctcttcaatacgttttccagaatccaaagcattttggtttatccaggacccagggcagcacagctgtcaccaagcaggagagttaaggattcaccatgagctgggaaatgcttttgccatgagtatgagcaaattccctctttccctgaatcatggacattctagattaaaagaacatttttttgtgctcttaacaagaaaaccatggccctcctttgttcaagtatcagaagaaataaacccacagctccagagaaggtgaccattctcagaactccagctattcactctccagggagaaggacctcaaatcgccactctttgggcggcaggtgcggtccccacggccggctctacgaggaagagttctggctcttttgtccactgagatggtcttggtttttcacttaacaaattttttaatggaatctttgtttttgttctccatcttgtttgttagagtctctcggcctttatttacaaattccttgcaactagagcgctccttccccaagatatggtagtgagagtaatttttcattgtagctgtagtctccatcagtaacagcaggccctggaagacttgatcacctttttctgtgtcattttcagtcaaagagggcctctcttacatcttgtttgctttcaaatccccaaatatcatctccatctcccaattaattttattgtctctttcctctctattcgctttctcctgttttttttttaaaaaaaaagcatgaaaaaggaagagaaaaagtttgatatgccaaggacagattttgaaacagacttggtaaatgttttccttagctccttcatgggcatgctggtgaaagaataaatacatccaattaaagctcatgctggggtcggggagaagaggatactgaaacatttgtgaaatgtatgaatgcacttctgtaaccagatacttctgttcttctgttcaaattgtggggtttttgttacagttaggacgcccatgaagatttaggggtgaaaaaaacagcagagtatttattaaactacagcattgtacaattagcttagtaacactatggaataagctaaaacatatcacagtttttacatgggccaaaacatgaattgagtatgtggtcacatgaaaacacggatgaatgaataaaacactctttggtggtgactgaggcatcattagaaggcccagacgatttccactattcacagcatttccttttctcagaaggactctttatatttccatgtaaatctagatctttggagcaattaagatggaattacaatttctagggagcattttaaggaaaatgttttggctttttcataattttatgtcttacagtatggaattataatacgaaaatctttatatgagttttggcttcttggtatttgtacttattcaggggaaaaagtctttcgattacttatgcctctatagagcttaatttcttgagaaattcaacagtcattttcaccagcataattttatcttaaggaataactaataggaaaagtcagcttaattatttaaggccctagtttctacatataatatattcgatagaaatgaaaatctgccgtggaattaactaataagtagtaacaataaacttcatatttagaatgcaaagtctataaagaataattttacatgatcctcaatatcaactccagtttaaaaagtgttatttttaaaacatttgaaaccaagtactgtttaatttcaatcagaagatgcaaatacatactttgatctatgtttgattttgctaataatatttgaaggagattgcctaccaaggacaaaacaataaatttaaaaatcaaacgatttctccatacgctcatagtcacatatggaattttgagaaaataaagcatgctgtctttaggaatttttatacttctttgtctttcttccttaatatttgcttctagctgctcttggcaatgatgaattgttatgtatgcattaatgttttgcagcccaaaagttgttcacatttttcctatataagatctgtggagtgtgtgtttcaaagagagaactacagaaatgttaaagcaggaaaacctgaatgtgatgtgcacattttcatcccacatggacaatgtatgtgttttaataaatggaattttcagattcatttca

SEQ ID NO: 8679 - DNA, 763 bp, Homo sapiens
  ENST00000556471
cctcaggctttaggaactgaagagggatgatactgtgaagtgttcaggaatgaagtctcgtgatgtctgctacctagtttcaaatggcaggagagacagagggatggggaagcaaaagtgaccattgttaactctaggtggttggtcataaaattgctgttatgtatgtgaaaacggccaaatataccatagaccccagattaggatcagtctggtgcctctgaaaatgtgaattgagaagaactgaaagaaaatctttccctggggagactgcagccgaaacacccttctgacgaatgtgctgacctaatctaagcctcaatttccttcaacaagggatgcatcgctcacttcccttgagttgtgagaatgaaacaagataatgcgttaaagcccttggcccagttcctggcatgtggcgagctcttggtccataagcaaatcttcgtattagtgtgagttcctggtcctccatgaaagaacaaagcttttggcctgtaaaatctaatttctggaaatgagaagcactaaaaagaagaggagtggggacggagtggggaggcacttggaaggctcctgttttgttttgttttgttgacaaattcattcttcatcttagccagcgccatggagtgagtccagctctctgtgtctggccccgctgtgaaccccctgaggctatccacagttggatatcttcctgttccttccctgccctaccctcttcaaatgcaaacttgggggggctcaagattattccata

SEQ ID NO: 8680 - DNA, 430 bp, Homo sapiens
  ENST00000554875
ttaactctaggtggttgaagatattgaaattgcaatcatcttgtttttgggggaatggagtcattccatattggctcttgagtatgtctgccaccactctgattctagctggaggctgccagaaatgactgtgccattgaatggagttattaggcaacataaaacggacaagccagaccaagtgtttctgaaagatctatccagcactccgatggccagcaacaacaccgccagcatagcacaagccaggaagctggtagagcagcttaagatggaagccaatatcgacaggataaaggaagttcactgacccctggtctacagcgatggttctcagctcatctgtgcgttcccaacacccagagagctctataaaaggaccaattaccgaaccacacccaaaccaattaaattagaatctcctggggta

SEQ ID NO: 8681 - DNA, 1294 bp, Homo sapiens
  ENST00000615906
ggcgtcgccttctcccctcagcacagaggagaggtgacgaatgccacttggtctctgcagcgtctgtagagggaagtctgtaagcgggagtgtcaaccccaattggcagattctctgacacttcaagtctgcaaaggaaaagcaggtacgactcctttatcttggacagtcatcttgtaatgcaggcctgtgggatacaaaggagaccagggaggttatgtgagctctgccaaatctattactactccaggggaaaataaaaccaaattcttgggctagtggaattactgtaggagaaatccagtatgattccatgtgaagaaccaatagcacccttaaattaaagccagatctgccagtgagcctcaggctttaggaactgaagaggtcataaaattgctgttatgtatgtgaaaacggccaaatataccatagaccccagattaggatcagtctggtgcctctgaaaatgtgaattgagaagaactgaaagaaaatctttccctggggagactgcagccgaaacacccttctgacgaatgtgctgacctaatctaagcctcaatttccttcaacaagggatgcatcgctcacttcccttgagttgtgagaatgaaacaagataatgcgttaaagcccttggcccagttcctggcatgtggcgagctcttggtccataagcaaatcttcgtattagttgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggt

SEQ ID NO: 8682 - DNA, 547 bp, Homo sapiens
  ENST00000479230
gacaccagcagctgaatgattagaacaggagaacactggttgccagcagtatggaaagaaaggttggggatctccaggaaacagaaagaaggagcaaaagaatcacatttgaaaatcctgagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggt

SEQ ID NO: 8683 - DNA, 2040 bp, Homo sapiens
  ENST00000418458
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgatgtgtttgtgcttccttctacagccaatatgaaaaggcctaagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattg

SEQ ID NO: 8684 - DNA, 533 bp, Homo sapiens
  ENST00000468146
aagtgcgtgacgctcgtcagtggcttcagttcacacgtggcgccagcggaggcaggttgatgtgtttgtgcttccttctacagccaatatgaaaaggcctaagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaagttctggtcattttttccttgataggtgattgaagcct

SEQ ID NO: 8685 - DNA, 2041 bp, Homo sapiens
  ENST00000394799
gctcgtcagtggcttcagttcacacgtggcgccagcggaggcaggttgatgtgtttgtgcttccttctacagccaatatgaaaaggcctagtaagtggggtcgggaggcgggcgtggagggacccacgtctggaagttgctgcagccaccacgacgctcttctacggctacggctttgtctctgctgagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattg

SEQ ID NO: 8686 - DNA, 263 bp, Homo sapiens
  ENST00000468885
tcagttcacacgtggcgccagcggaggcaggttgatgtgtttgtgcttccttctacagccaatatgaaaaggcctaagttaaagaaagcaagtaaacgcatgacctgccataagcggtataaaatccaaaaaaaggtaagtgtagtgcttgagagagctgtaccaaacacattgctaaactgattttgccctgttcctttgcgggaaagtctgggttaatgtgatttggttttgggaaatggcattggatagactgaccatgg

SEQ ID NO: 8687 - DNA, 597 bp, Homo sapiens
  ENST00000462550
agttcacacgtggcgccagcggaggcaggttgatgtgtttgtgcttccttctacagccaatatgaaaaggcctaagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggtatgattaggtctctttatgaatgagagatcaggggttttgattttggtttttttgcttgggcctgagtgcagtggcacaatcacaactcactgcaacctggaccacccaggctcaagcagtcttaccacctcagtctccaagtagctgggactacagaagcacaccatcacgcctggctaattttttttagcagacacgggctttcacta

SEQ ID NO: 8688 - DNA, 729 bp, Homo sapiens
  ENST00000492349
agttcacacgtggcgccagcggaggcaggttgatgtgtttgtgcttccttctacagccaatatgaaaaggcctaagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtatcttagcctaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaag

SEQ ID NO: 8689 - DNA, 2118 bp, Homo sapiens
  ENST00000496254
agcggaggcaggttgatgtgtttgtgcttccttctacagccaatatgaaaaggcctaagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaaggtatcctttattagtggtaagaaatgtgattctttcagattttggttgaaatatgatgagtgtacaaaatcttgatttaagtgaatgaaaaattacaagatccaactctgatttcagccagagatcatctgaaaggcaatgtagttatcttaagagctgggctctggagcctgattgcttggggtttgttgaaatttatcaggtaagttgccagaataattcaactatttggaattttagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagta

SEQ ID NO: 8690 - DNA, 567 bp, Homo sapiens
  ENST00000474423
gctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaagg

SEQ ID NO: 8691 - DNA, 583 bp, Homo sapiens
  ENST00000460073
ctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaa

SEQ ID NO: 8692 - DNA, 668 bp, Homo sapiens
  ENST00000484022
gtgaagacatgagatccaactctgagctcaccctgttgctaaatggataatgccagtactctcttgtggaaggtattaccagaacaagggatgtagttctgatcattttctccttgataatgtagttctggtcattttttccttgataggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttc

SEQ ID NO: 8693 - DNA, 523 bp, Homo sapiens
  ENST00000497356
ttggttttttttttaaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacagggtaagctttcttttctgttggcattttggtgaccactagaataaaccttcttttgacacatcttatttttaatatcagtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtga

SEQ ID NO: 8694 - DNA, 6447 bp, Homo sapiens
  ENST00000370602
cggggtcagcaccgcggagacccccctcgcccggccccgcgacagcctccgagcgcccccggatcatggccaccgaggtccacaatctgcaggagctccggcgaagtgcctcactggccaccaaggtctttatccagagagactacagcgatgggaccatctgtcagttccagaccaaattccccccagagctggacagccggatcgagcggcagctctttgaagagactgtgaagaccctcaacggattttacgcagaggctgagaagattgggggcagctcctacctcgagggctgcctggcctgcgccacggcctacttcatcttcctctgcatggagacccactatgagaaggttctcaagaagatttcccgctacatccaggagcagaatgagaagatctttgcacctcgaggcctcctacttacagaccctgtggagcgtgggatgagggttattgagatctccatctacgaggaccggtgcagcagtggcagctccagcagcggcagcagcagcggcagtggcagcagcagcggtgggggtggtggggcgggggcccggtgactggccgagagtccctgtagggaggtgtatggccggagtgagggccttgcagacctgcggcggctgcgctaccagagcacccgcttctgagtcattctttgggctcaccctgctgcccggggtgggagggagggtgacgggcctcatatttcctgtgggccatcaacctatgccccctgtccctcacccccgtctggatcagtccatttcctgacctgggggcttttccttcccgatggggctggtctgggccacacagagacagatcttcctaggaaggctggggtggggagaacacaacctaggcggcccctctcttccacagcccctctcccaaccctgcgaggggggccgaggcctgccacatagaggactcccacactgcatgacccctcatcccaaacccatatccaccaggactctttcccttgggccctgcgtcccgtggctgtctcccagtatctgttccttctcatgcccctgcagggccccggcctgtctatgatcctgcctccaccaaattcaaggtgtggggagacgggtgccgtggttgggagctgttcagcgcactcctgacctcttctagacctatggctttcctgtcctgcattcagagctagaggccagctcggccttgcgagaagcatccaactttgagactttgcaggctgccaggtgctggttggggggcacagagcctggggctctgggaggtaatatgggggtctgggaaactccgtgaagagacatagccatgcggggcctgaatctcctgaactacagccagtttcctgagattagaacctgtgtgtatgcacatgtgaatgtatgtgtgagtgcacatgtgtgtaagtgcagtgtgcgtaaatgtgtgagtctgcgtgtgttagcatgcctgtatgtgagcgcgtgtgtgagcgcatgtgtgtgcaccagtgcacaagtgtatgaatgtggacacatttataagcacacctgtgtgtgtctgagtacatgtgcacacacgtgtgcacaaatgtgcatttatatgagtgtgagtgcatgcatgtgcatgaacatgtgtgcacaagcatgtgtgtatgagtgttcatgtgtatgagtgtgtgtgtatgcaggtgagtgcatgtgtgtgtgagtgtgtttgtgtgttccccttggctgccaggccaacgactgcttctctgcatcctgctgtcttcgctacctgagggtctgtgacttcttccctgtgtgggtccagcctgaccccctgtaagtaaatgtccaaaagccccttgcccctcccctagggctaccagggaacatactctactgcatatgttctagtggaagagaagccggggttctaggaaagaagagccaaactttggtggcctttggtgccccctctcagctccccatgacaagacaacggggctgcagacactgtgtgttcagcctgcccaggggctggggctctttaaggctttgtaggtgaggtttccatggaccttcaaaggtgccagcagcctgcaggggaaaggcaaactccctccttgcaaggaaaggagatgtccagccaatgatgcccggcttctgaggcccagaggagcaggtgggatgggagcagcccctggggctggtgtcccgaagatgaaatgaagggggctgcctatctcagttggcgggaggtgttagaagtggatgtgcaagaccagccactggaggtagctctctggagtcaaagagaggcctgcttttctaccagacatgggagcagcatgtaggatacaagggcctacccagagaccagagagagtcagcctagtccttgcagcctcaggaagtcctcggcccaagtgagtcctggtccaaggatccccctggagagccgcagttcagtgggctccaccgcagcccctggccacggcctatgccctccctgggcccctgtggggctgggcattgtgtctgacctgtgcatctcccatgggagggctgggcacaggcagtgctatggccttttttttttttttctttttccaataaaagaacttgcccagcgtgaagctctgtgatgctttctctgccccgtgacgatggagggtcagttctatgctccaggaccacatgaggggatactcagctgcctgaactggacctgacatggggagcaggatgaactctgtcttcttggagcttgcagtctactgaagaggcagacacctcagcatctctaatctggaatctttggggcacttgtagccttgggtgggggaacaggttggactgaaagcgaggccaaaagtaatcaattaatgatatcaataaatcctcatttcttgagctcttcccctgggttgggtcctgttgggagctggatcacacaggtcactcagtactgaagatgagaaagtagctggatgatcacttctcggccttttggccaagatcaaatatggagaaagtagctggatgttggaacctagcagagttgtgtcttgaattttataatttattgagcacctactatgtgccagatactttgctgaaaccatatgttagagctggcaggggatttaaagatcacttgaatcctgtcacagaggtccagagagggtgggtgacttgccctaggccacacagctggttgatgataacagggcccaagcttggaacccaggtctcctgactcagtgcccactctgttaccacagggatggcacccagatgggaagctgcctgaggctgcagggaggctgggatcacaaactcaggcctgttcccagagaggggctcatcagactgtggggacaacggctccagcctcttaggtgggggctgggcagtcccctctgggtggttctcatgtttgttgtcactgccgctaagggctgcagtgagctgtgtgcagcctggactcactccctctgctggaacctgggccgtgtgtgggttgccacaagtgagcgtgttctctaatatgagggcaggttcattctgttttgggataggaagtttgttctaccccgaggccagatttgaatccaaactcagctcttctagagatgaggtcctggggagggggtgaggatttactaaacgggtaaaaccaaatctgggtgcttatctgactgagaggcattcaacccttccattttcaaatggtaatcataataataatagtagctgacgtttatttagcacttcctatgtgccaggcactaggctaagactctacataattagtcattcaattctcacagcaaccctctatggcatggattcttatttcccattttacatatggggaaactgaggctcatggacgttaagtaactgggaaattgcagatcttggctttgaatctaggcaatctgactccaaactgcaaggaagaagacagatccagcctcagaggccgcttaacagcttgagggcctcagccgtcctgggattaggatcaggcagattcccagggaaggacttggagccatgcctgggttttgaggccgggctggcacctccacttccagggcatcacgggagggtgcatgggctgtgctcgcaggcatgcgggacccagaggcagcccggtgaagggtagtgggggactcgactcactgtgggcctggggaggtgtggtttctctctgctggcttagttacaggtggtggcctgtctctccggggtctggctgtagccatgtccctgcacccaccttgccagccagggacaggccccatcaagacccaggagcagctccagcctcagccagactgtccccgaggtcccaagtgaggccccagccactcaggcatgcctcaggaagctcctgctgcacatgctcctctccctgcgccagcaccctgctgtctggcttccttcctttggccacagggcgggtgtgtgtgaaaccacagggtttacagaagctcgaggtgccactgagtggcaggattatgcactgcactcggggaatcaaaggtggagacagaaagaactatggctgttgtgacacgtcccccacggctccccggttggcagccactgccacccgcagggacttttctgtggcttccagaggtgtggggcaaaggtggagtctggtgactttctccctagggccagcccctgggctgtcgagcctgggaaactccacatccctctccacacctctagaaggactcacaatgaggggggcccagacaggaggcatcaccacctggtttgggctttaccattcacccagggataaggcaaggcaaacaccactccacatcagatctgaatttgagctctggcttcatgacactgacacatgaagactcttggagcctcagattccccagttgttaaatagggagactaatatctcacagagttgtttagacccgaggcgttcaaccttggtggcaatggatgtcaactggaagcatgaaaaatcaccaatgcctgatcctatcctcagagattctgatttaattgttttgggggacagcttgggcatcaggattttaaagagtttccctggtgattttaatgtgaaggtaaggctgagaatccctggttttgacagtacctatagcctataagcctttaatacacctctgaaaatgcctgagacctgaataagaagtttatggttccacagaagcagccagacacaaaaatgcatatgcaccatgtgattccccttatatgaaactgaaagacaggccaaactcgcctttgattgggagtcaggatcaagattaccctgggtcgggggtagcgaatggatggggacctggggggcttctgggagctcaggatgttctgtttcttgatcagagtgccagttacacggggtgctcacttcatgagaattcactgagctgtatacttaagagctgtgtatttgtctgtactggtgatatatttcaataaaattcaccagaaaagcctgttggctacaaaataggaaaagaaaggacacacttgaaattaacgttttgttaaatatctggaaatgtaacacatatgccaaacagacaactgcaactctatgttacgtgtgtgtgtgtgtgtgtgtgtgaaaatgtaatgtctgctctgctgtgggtgggccctctaaaagggaaggtccctgatgcctaagaaaatctgaaaacagcccaggttcacaccaggagttcttaacctcgacccgactgcattcaggtgcatattatgtgccgttatctgaggagagcatctacagctttcagcagattctcaaaggggtatgcaaccccctaaaaaggttaagaacaattggttttgaggagtcagtaagaaactggccatgaatgtgcttggcatgaaagagatgcttggtaatgtcggtttctttccttcctttcagagcccagccttcggaggtttccgcatgagccttctcgggcgacttctaggaggatttattcccctggcagtgccaagggcagcctgcaccaagctcacaactcttcctccaagaggatgttcaaagggcctgtcatttcagcatctgctggacagcagaacttcgcatgcaggatcctggagctgcgtcgggttttgaatcagggacaatggaggaagtgggaaactgtgaagagagtcagagggctgtgccagctgccccctttcccacccccagcaattcacttaactttcctgagtctcacctttgtcattatgagaatgtgtatatttataaataatcatctgtttctccaatgtaagatattgttattgcagaagtgatactaggacctcgttatacgatggcctcatgatgtagatttatagcaggcttcagattctggcatagaataaacagatatttatccaagggttcactgattcccgaataaatgccaggaacattcatgta

SEQ ID NO: 8695 - DNA, 660 bp, Homo sapiens
  ENST00000423054
tggggagacgggtgccgtggttgggagctgttcagcgcactcctgacctcttctagacctatggctttcctgtcctgcattcagagctagaggccagctcggccttgcgagaagcatccaactttgagactttgcaggctgccagagcccagccttcggaggtttccgcatgagccttctcgggcgacttctaggaggatttattcccctggcagtgccaagggcagcctgcaccaagctcacaactcttcctccaagaggatgttcaaagggcctgtcatttcagcatctgctggacagcagaacttcgcatgcaggatcctggagctgcgtcgggttttgaatcagggacaatggaggaagtgggaaactgtgaagagagtcagagggctgtgccagctgccccctttcccacccccagcaattcacttaactttcctgagtctcacctttgtcattatgagaatgtgtatatttataaataatcatctgtttctccaatgtaagatattgttattgcagaagtgatactaggacctcgttatacgatggcctcatgatgtagatttatagcaggcttcagattctggcatagaataaacagatatttatccaagggttcactgattcccgaataaatgccaggaacattcatgtaca

SEQ ID NO: 8696 - DNA, 6378 bp, Homo sapiens
  ENST00000596005
tctcctcaggtccacaatctgcaggagctccggcgaagtgcctcactggccaccaaggtctttatccagagagactacagcgatgggaccatctgtcagttccagaccaaattccccccagagctggacagccggatcgagcggcagctctttgaagagactgtgaagaccctcaacggattttacgcagaggctgagaagattgggggcagctcctacctcgagggctgcctggcctgcgccacggcctacttcatcttcctctgcatggagacccactatgagaaggttctcaagaagatttcccgctacatccaggagcagaatgagaagatctttgcacctcgaggcctcctacttacagaccctgtggagcgtgggatgagggttattgagatctccatctacgaggaccggtgcagcagtggcagctccagcagcggcagcagcagcggcagtggcagcagcagcggtgggggtggtggggcgggggcccggtgactggccgagagtccctgtagggaggtgtatggccggagtgagggccttgcagacctgcggcggctgcgctaccagagcacccgcttctgagtcattctttgggctcaccctgctgcccggggtgggagggagggtgacgggcctcatatttcctgtgggccatcaacctatgccccctgtccctcacccccgtctggatcagtccatttcctgacctgggggcttttccttcccgatggggctggtctgggccacacagagacagatcttcctaggaaggctggggtggggagaacacaacctaggcggcccctctcttccacagcccctctcccaaccctgcgaggggggccgaggcctgccacatagaggactcccacactgcatgacccctcatcccaaacccatatccaccaggactctttcccttgggccctgcgtcccgtggctgtctcccagtatctgttccttctcatgcccctgcagggccccggcctgtctatgatcctgcctccaccaaattcaaggtgtggggagacgggtgccgtggttgggagctgttcagcgcactcctgacctcttctagacctatggctttcctgtcctgcattcagagctagaggccagctcggccttgcgagaagcatccaactttgagactttgcaggctgccaggtgctggttggggggcacagagcctggggctctgggaggtaatatgggggtctgggaaactccgtgaagagacatagccatgcggggcctgaatctcctgaactacagccagtttcctgagattagaacctgtgtgtatgcacatgtgaatgtatgtgtgagtgcacatgtgtgtaagtgcagtgtgcgtaaatgtgtgagtctgcgtgtgttagcatgcctgtatgtgagcgcgtgtgtgagcgcatgtgtgtgcaccagtgcacaagtgtatgaatgtggacacatttataagcacacctgtgtgtgtctgagtacatgtgcacacacgtgtgcacaaatgtgcatttatatgagtgtgagtgcatgcatgtgcatgaacatgtgtgcacaagcatgtgtgtatgagtgttcatgtgtatgagtgtgtgtgtatgcaggtgagtgcatgtgtgtgtgagtgtgtttgtgtgttccccttggctgccaggccaacgactgcttctctgcatcctgctgtcttcgctacctgagggtctgtgacttcttccctgtgtgggtccagcctgaccccctgtaagtaaatgtccaaaagccccttgcccctcccctagggctaccagggaacatactctactgcatatgttctagtggaagagaagccggggttctaggaaagaagagccaaactttggtggcctttggtgccccctctcagctccccatgacaagacaacggggctgcagacactgtgtgttcagcctgcccaggggctggggctctttaaggctttgtaggtgaggtttccatggaccttcaaaggtgccagcagcctgcaggggaaaggcaaactccctccttgcaaggaaaggagatgtccagccaatgatgcccggcttctgaggcccagaggagcaggtgggatgggagcagcccctggggctggtgtcccgaagatgaaatgaagggggctgcctatctcagttggcgggaggtgttagaagtggatgtgcaagaccagccactggaggtagctctctggagtcaaagagaggcctgcttttctaccagacatgggagcagcatgtaggatacaagggcctacccagagaccagagagagtcagcctagtccttgcagcctcaggaagtcctcggcccaagtgagtcctggtccaaggatccccctggagagccgcagttcagtgggctccaccgcagcccctggccacggcctatgccctccctgggcccctgtggggctgggcattgtgtctgacctgtgcatctcccatgggagggctgggcacaggcagtgctatggccttttttttttttttctttttccaataaaagaacttgcccagcgtgaagctctgtgatgctttctctgccccgtgacgatggagggtcagttctatgctccaggaccacatgaggggatactcagctgcctgaactggacctgacatggggagcaggatgaactctgtcttcttggagcttgcagtctactgaagaggcagacacctcagcatctctaatctggaatctttggggcacttgtagccttgggtgggggaacaggttggactgaaagcgaggccaaaagtaatcaattaatgatatcaataaatcctcatttcttgagctcttcccctgggttgggtcctgttgggagctggatcacacaggtcactcagtactgaagatgagaaagtagctggatgatcacttctcggccttttggccaagatcaaatatggagaaagtagctggatgttggaacctagcagagttgtgtcttgaattttataatttattgagcacctactatgtgccagatactttgctgaaaccatatgttagagctggcaggggatttaaagatcacttgaatcctgtcacagaggtccagagagggtgggtgacttgccctaggccacacagctggttgatgataacagggcccaagcttggaacccaggtctcctgactcagtgcccactctgttaccacagggatggcacccagatgggaagctgcctgaggctgcagggaggctgggatcacaaactcaggcctgttcccagagaggggctcatcagactgtggggacaacggctccagcctcttaggtgggggctgggcagtcccctctgggtggttctcatgtttgttgtcactgccgctaagggctgcagtgagctgtgtgcagcctggactcactccctctgctggaacctgggccgtgtgtgggttgccacaagtgagcgtgttctctaatatgagggcaggttcattctgttttgggataggaagtttgttctaccccgaggccagatttgaatccaaactcagctcttctagagatgaggtcctggggagggggtgaggatttactaaacgggtaaaaccaaatctgggtgcttatctgactgagaggcattcaacccttccattttcaaatggtaatcataataataatagtagctgacgtttatttagcacttcctatgtgccaggcactaggctaagactctacataattagtcattcaattctcacagcaaccctctatggcatggattcttatttcccattttacatatggggaaactgaggctcatggacgttaagtaactgggaaattgcagatcttggctttgaatctaggcaatctgactccaaactgcaaggaagaagacagatccagcctcagaggccgcttaacagcttgagggcctcagccgtcctgggattaggatcaggcagattcccagggaaggacttggagccatgcctgggttttgaggccgggctggcacctccacttccagggcatcacgggagggtgcatgggctgtgctcgcaggcatgcgggacccagaggcagcccggtgaagggtagtgggggactcgactcactgtgggcctggggaggtgtggtttctctctgctggcttagttacaggtggtggcctgtctctccggggtctggctgtagccatgtccctgcacccaccttgccagccagggacaggccccatcaagacccaggagcagctccagcctcagccagactgtccccgaggtcccaagtgaggccccagccactcaggcatgcctcaggaagctcctgctgcacatgctcctctccctgcgccagcaccctgctgtctggcttccttcctttggccacagggcgggtgtgtgtgaaaccacagggtttacagaagctcgaggtgccactgagtggcaggattatgcactgcactcggggaatcaaaggtggagacagaaagaactatggctgttgtgacacgtcccccacggctccccggttggcagccactgccacccgcagggacttttctgtggcttccagaggtgtggggcaaaggtggagtctggtgactttctccctagggccagcccctgggctgtcgagcctgggaaactccacatccctctccacacctctagaaggactcacaatgaggggggcccagacaggaggcatcaccacctggtttgggctttaccattcacccagggataaggcaaggcaaacaccactccacatcagatctgaatttgagctctggcttcatgacactgacacatgaagactcttggagcctcagattccccagttgttaaatagggagactaatatctcacagagttgtttagacccgaggcgttcaaccttggtggcaatggatgtcaactggaagcatgaaaaatcaccaatgcctgatcctatcctcagagattctgatttaattgttttgggggacagcttgggcatcaggattttaaagagtttccctggtgattttaatgtgaaggtaaggctgagaatccctggttttgacagtacctatagcctataagcctttaatacacctctgaaaatgcctgagacctgaataagaagtttatggttccacagaagcagccagacacaaaaatgcatatgcaccatgtgattccccttatatgaaactgaaagacaggccaaactcgcctttgattgggagtcaggatcaagattaccctgggtcgggggtagcgaatggatggggacctggggggcttctgggagctcaggatgttctgtttcttgatcagagtgccagttacacggggtgctcacttcatgagaattcactgagctgtatacttaagagctgtgtatttgtctgtactggtgatatatttcaataaaattcaccagaaaagcctgttggctacaaaataggaaaagaaaggacacacttgaaattaacgttttgttaaatatctggaaatgtaacacatatgccaaacagacaactgcaactctatgttacgtgtgtgtgtgtgtgtgtgtgtgaaaatgtaatgtctgctctgctgtgggtgggccctctaaaagggaaggtccctgatgcctaagaaaatctgaaaacagcccaggttcacaccaggagttcttaacctcgacccgactgcattcaggtgcatattatgtgccgttatctgaggagagcatctacagctttcagcagattctcaaaggggtatgcaaccccctaaaaaggttaagaacaattggttttgaggagtcagtaagaaactggccatgaatgtgcttggcatgaaagagatgcttggtaatgtcggtttctttccttcctttcagagcccagccttcggaggtttccgcatgagccttctcgggcgacttctaggaggatttattcccctggcagtgccaagggcagcctgcaccaagctcacaactcttcctccaagaggatgttcaaagggcctgtcatttcagcatctgctggacagcagaacttcgcatgcaggatcctggagctgcgtcgggttttgaatcagggacaatggaggaagtgggaaactgtgaagagagtcagagggctgtgccagctgccccctttcccacccccagcaattcacttaactttcctgagtctcacctttgtcattatgagaatgtgtatatttataaataatcatctgtttctccaatgtaagatattgttattgcagaagtgatactaggacctcgttatacgatggcctcatgatgtagatttatagcaggcttcagattctggcatagaataaacagatatttatccaagggttcactgattcccgaataaatgccaggaacattcatgt

SEQ ID NO: 8697 - DNA, 1947 bp, Homo sapiens
  ENST00000370508
gaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaaga

SEQ ID NO: 8698 - DNA, 646 bp, Homo sapiens
  ENST00000489349
cttctccaagaacttcgggctctacagtgagtgctctcctgaggagttacagccccacctcctcgcatcactccctgcttcagcagccacagctgattctggtccctctctttagatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacatacc

SEQ ID NO: 8699 - DNA, 716 bp, Homo sapiens
  ENST00000471741
agacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaagttttgggtaaggatgtattttctctttagaaactgaaagtaaaaagatgttgagaatacagtttgtttaaaatattaggcgttatgtctattgaactgccaatgaataagtgtttctgtagcgcgagttcaggaacctgatagcgcaaataatgtggccatgtacaaagcacggctttttcacttgttcagttttgcccagtagatcatcagattttagctactgcatttgaagcagtcagtggagatgccaagtagaaagaatttaatggagtgataaagacaccagggttctagatccaactctgccactacttttgatcataggcaagtcatttagccctctgggctca

SEQ ID NO: 8700 - DNA, 1972 bp, Homo sapiens
  ENST00000368232
cggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaacttttaggtggtggaaccagggaagcagagagcagagcatgcagtgatggaagaagcaggaaaagcaagaagaaaagacagcagcatcaagaggaggaggacatcttggatgtaagggatgagaaggatggcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggacgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaa

SEQ ID NO: 8701 - DNA, 1159 bp, Homo sapiens
  ENST00000438976
aagatggcggcgcacaagtcaggtccggcacatgtttccgcggagcggacccagcaatgacgaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaacttttaggtggtggaaccagggaagcagagagcagagcatgcagtga

SEQ ID NO: 8702 - DNA, 934 bp, Homo sapiens
  ENST00000415314
aacaaaacggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaa

SEQ ID NO: 8703 - DNA, 740 bp, Homo sapiens
  ENST00000494414
caggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagatgtgagacttcattttagctcttggggaatgtgggaagagatgtcttcagatggcaagagaaagggctaaatctaatgcttgactgggggcttcttgggggtgggtggaactgtgttgtactaatctttgtatccctagtacctcaaaaagtgccaggtcctgaacaagaattcagtgttgaaggaatgttttagaaggaggagaggtcaagcctttccaccaggtctgtttgtaactgctgatctcccctaacagtctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaa

SEQ ID NO: 8704 - DNA, 837 bp, Homo sapiens
  ENST00000497287
atgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattacctcaaaaagtgccaggtcctgaacaagaattcagtgttgaaggaatgttttagaaggaggagaggtcaagcctttccaccaggtctgtttgtaactgctgatctcccctaacagtctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagc

SEQ ID NO: 8705 - DNA, 857 bp, Homo sapiens
  ENST00000463513
ggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagactgcccagaccctcagcaggaattgagatcttcaggttccgtggatcctgccatctgttaagggagcagcaatagggcgtgggagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatc

SEQ ID NO: 8706 - DNA, 534 bp, Homo sapiens
  ENST00000498641
cttatctacccccatgacccctcctagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaagtaagtagtggtcagctccttgagctcccttttctccccacctttgaccatggcctgtgccacctcttggttctttttaccccagggaaatgattcctattacctacccatctattgcctgaagataggcagctccccactcctaccctccaccaactttccctgcaggcttaaggactaggcccatttcccccgataccctcgctttgacttggaccctgtctgtttcagggctgcccgtcttgggatcacaatgaaggccaagcttgctcgcctagaggcccaggagcaggccttcctggctcgtctcaaaggccaggaccctggggcccctcaactgcagtcagagagcaagccccccaaa

SEQ ID NO: 8707 - DNA, 552 bp, Homo sapiens
  ENST00000529520
atctacccccatgacccctcctagatggctacattgacttcaggtggagagaagccaaacaaagacttggagagctgcagtgatgacgacaaccaggggtccaagtccccaaagatgtgagacttcattttagctcttggggaatgtgggaagagatgtcttcagatggcaagagaaagggctaaatctaatgcttgactgggggcttcttgggggtgggtggaactgtgttgtactaatctttgtatccctagtacctcaaaaagtgccaggtcctgaacaagaattcagtgttgaaggaatgttttagaaggaggagaggtcaagcctttccaccaggtctgtttgtaactgctgatctcccctaacagtctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagcccccc

SEQ ID NO: 8708 - DNA, 2464 bp, Homo sapiens
  ENST00000473910
gaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaaggtattagaggctgtgggtaacagagtccatcctttttctcttccctggtttccctggggcctgaacagttgccttgtatgccttatcaattctcagaactttcctaacatagtgggatcctgtgaccagccttgctgttgcttacttagactgcccagaccctcagcaggaattgagatcttcaggttccgtggatcctgccatctgttaagggagcagcaatagggcgtgggaggtagggtacagtctcttaagtcaggagctgccaaattttgggggggccaggggacatctaattcaaaggacttagaagccagaggagacctgagagattatctggaccatccctgctttgcagatgtggctaaaagggtgaaaagtggtttgctgaagagcccacagctggctagtaatggcaaacaggactggaacccaggacttcaggcctccactttctactgtaccaataggaggaagctaacatgtaatggtcattatgtgctaagggctatacatgttacctagcaaatctttcccatttctctacatctctgttaccatctactaccccacttcgggccatcatcatctcttgcctaatttctttctccagcagcctcctaagaacacctgtagtctcactccccaccccaacctttgtggaggatggacttctccacaaagcatccagtgttctctctaaaacataaatgtcatcatgtcactgggtcttgtttgacctaggatgacacaatccagatttatcggactggcttatatggctctgcatgcctgttcctgccatctccagcctcatctcttcacttttctccaggaccactactttagcctaaccattagcataacagattccaatctgtttcttttctttgaaggtacgacagtcttccatcttcaggttattgcacatgttgctccctctgcttgggacattcttctccctttccccctttaccttctgagtttctcttatcctccagagctcagcttatacatcagttacttttagaagccattctctgaagtctgagttgagtacccttcctctatcacaggcaacacttccatcataattgcctatgtagattccatctgggctgggcccatctcattcttattccactctgaatccccaactccttggcccatagtagactctcaattaatctgattaaatgaaggtactgtgaacaggtactatggtcggggtggagcggggcatctttactgtcagtcactggcacttgtccactgtgaagacctgatgaaccagagcatttcctcttcttgttctgctcaccagccagctgtgggtgagagaggccaaagctgctgcacatcccagcagcagcagcccatctcctatccaagttcgagtatgcaggatggcacacctccctgtggctcctcaaggagcaatggtgggggctggcaaaccactgcctggagctataaattcttagggggcttccacaagggaatagggatggtgatggtgttgagaaggccttatctacccccatgacccctcctagatggctacattgacttcaggtggagagaagccaaacaaagacttggagagctgcagtgatgacgacaaccaggggtccaagtccccaaagatgtgagacttcattttagctcttggggaatgtgggaagagatgtcttcagatggcaagagaaagggctaaatctaatgcttgactgggggcttcttgggggtgggtggaactgtgttgtactaatctttgtatccctagtacctcaaaaagtgccaggtcctgaacaagaattcagtgttgaaggaatgttttagaaggaggagaggtcaagcctttccaccaggtctgtttgtaactgctgatctcccctaacagtctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagcccccc

SEQ ID NO: 8709 - DNA, 532 bp, Homo sapiens
  ENST00000531129
atttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaag

SEQ ID NO: 8710 - DNA, 719 bp, Homo sapiens
  ENST00000474904
aagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagtgggatcctgtgaccagccttgctgttgcttacttagactgcccagaccctcagcaggaattgagatcttcaggttccgtggatcctgccatctgttaagggagcagcaatagggcgtgggagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaa

SEQ ID NO: 8711 - DNA, 634 bp, Homo sapiens
  ENST00000498756
tggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagatgtgagacttcattttagctcttggggaatgtgggaagagatgtcttcagatggcaagagaaagggctaaatctaatgcttgactgggggcttc

SEQ ID NO: 8712 - DNA, 1029 bp, Homo sapiens
  ENST00000506832
atttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaaggtattagaggctgtgggtaacagagtccatcctttttctcttccctggtttccctggggcctgaacagttgccttgtatgccttatcaattctcagaactttcctaacatagtgggatcctgtgaccagccttgctgttgcttacttagactgcccagaccctcagcaggaattgagatcttcaggttccgtggatcctgccatctgttaagggagcagcaatagggcgtgggaggtagggtacagtctcttaagtcaggagctgccaaattttgggggggccaggggacatctaattcaaaggacttagaagccagaggagacctgagagattatctggaccatccctgctttgcagatgtggctaaaagggtgaaaagtggtttgctgaagagcccacagctggctagtaatggcaaacaggactggaacccaggacttcaggcctccactttctactgtaccaataggaggaagctaacatgtaatggtcattatgtgctaagggctatacatgttacctagcaaatctttcccatttctctacatctctgttaccatctacta

SEQ ID NO: 8713 - DNA, 781 bp, Homo sapiens
  ENST00000527691
agaaggaacaaaacggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggtaggacatgaccctgccaaggagttcacaaaccactggtggaatgagctcttcaacaagactgcggccaacttggtagtggaaactgggcaggtatgagctcttgatagatgggcacatgaaacagagggcctgggacctgtggcgtaggcagtcatgatatgtcacccattcactggtactgataattctctacaggatggagtacagataaggagcctttctaaggagaccacccgttataatcatcccaagcccaacttgctgtatcagaagtttgtgaaggtattagaggctgtgggtaacagagtccatcctttttctcttccctggtttccctggggcctgaacagttgccttgtatgccttatcaattctcagaactttcctaacatagtgggatcctgtgaccagccttgctgttgcttacttagactgcccagaccctcagcaggaattgagatcttcaggttccgtggatcctgccatctgttaagggagcagcaatagggcgtgggaggtagggtacagtctcttaagtcaggagctgccaaat

SEQ ID NO: 8714 - DNA, 653 bp, Homo sapiens
  ENST00000531900
aagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggtatgagctcttgatagatgggcacatgaaacagagggcctgggacctgtggcgtaggcagtcatgatatgtcacccattcactggtactgataattctctacaggatggagtacagataaggagcctttctaaggagaccacccgttataatcatcccaagcccaacttgctgtatcagaagtttgtgaaggtattagaggctgtgggtaacagagtccatcctttttctcttccctggtttccctggggcctgaacagttgccttgtatgccttatcaattctca

SEQ ID NO: 8715 - DNA, 513 bp, Homo sapiens
  ENST00000525375
atttccgggaagatggcggcgcacaagtcaggtccggcacatgtttccgcggagcggacccagcaatgacgaggcagggtttcactacgttgcccacactggtctggaactcctgggctcaagtgattcttctaccttggccttccaaagtgctgggattacaaatgtgaaccactgtgcctggccgctttattctttttatgagagagggtcttgctatactgcccaggctggactcaagcaatcccgcctcagcctcccatgtagctgggactacaggtgtgtgccactgcacccaactagcagagaattcttaacaagcagtcaggatggaactgatggctgtttgggcactttctactttcttcttaaaaggatgatatcacctcttcttctctggtgagagtctgaggatagagacttttttctcaccatgaatgtcaccccagaggtcaagagtcgtgggatgaagtttgctgaggagcagctgctaaagcatggatggactcaagg

SEQ ID NO: 8716 - DNA, 2129 bp, Homo sapiens
  ENST00000471717
gtctcggcagatgccgcctggtccagctatcgtgctcggtattcagttttccggagcagcgctctttctctggcccgcggagcggtcccgcggccgagtaccggattcccgagtttgggaggctctgctttcctccttaggacccactttgccgtcctggggtggctgcagttatgtccgcgctgcgacctctcctgcttctgctgctgcctctgtgtcccggtcctggtcccggacccgggagcgaggcaaaggtcacccggagttgtgcagagacccggcaggtgctgggggcccggggatatagcttaaacctaatccctcccgccctgatctcaggtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatgagttttttctggagatgctctcagtagcccagcactctctgacccagctcttctcccactcctacggccgcctgtatgcccagcacgccctcatattcaatggcctgttctctcggctgcgagacttctatggggaatctggtgaggggttggatgacaccctggcggatttctgggcacagctcctggagagagtgttcccgctgctgcacccacagtacagcttcccccctgactacctgctctgcctctcacgcttggcctcatctaccgatggctctctgcagccctttggggactcaccccgccgcctccgcctgcagataacccggaccctggtggctgcccgagcctttgtgcagggcctggagactggaagaaatgtggtcagcgaagcgcttaaggttggagggtgcctgagtatgggcagggcccagggagggagaggtggaagtgagagagaccccacaaggaagaaacagccaccagccagcaggacaggccttgggctctgtctgcctccaggccctggtgtcctaggatgaattaggaaggagggggctggagtgaaacctccaatggtccacgatccatgatctctgaccccctcctcccctctgtggacccataccctcctcagtccccaagggcctgctcatctccatagcagtaggagattggatactgcccccgcccaaccccccaggatccctcaatgactccacttccctgctgctgaaggccagatgcctggcttggcctctctcactgcccatcctctacctgacctcccagcctcaccttctgcctcctgaccgcctcctccctccccagctgtgatgggctcactcttgtccttgaatgttccctccacccctaactgcctctctatttccacccctcccacgaatcagagtcagcaacctggaacctccctcctcagatctgtgacaatctcacctgctgccacgtggggtcaccaaccctaggtgtagggtggggtatgtgatttctgtctgtgcccagcaccaagccaggctgagagcagccacagcgtttgtggaggacacagccccactctctgcccccaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctgggtgaggggattcaagaaagcctggagccaggcatggtggctcacacctgtaatcacagcactttgagaggctgaggcaggaggatcacttgaggccaggagttggagcccagctggggcaacatagctagacgtcatctcaagaaagaaagagagagagagaaagaaagagagagagagagacagagaaagaaagaaggaaagaaggaaggaaagaaagaaaaagaaagaaagaaagaaagaaaagaaagaaatcagccaggcatggtagcgcccgcgcctgtagtcccagttactcctgaggctgaggcaggaggatcacttgaggccaggagttggaggccagcctgggcaacgtagctagaccgcatctctacc

SEQ ID NO: 8717 - DNA, 767 bp, Homo sapiens
  ENST00000480087
tcggcagatgccgcctggtccagctatcgtgctcggtattcagttttccggagcagcgctctttctctggcccgcggagcggtcccgcggccgagtaccggattcccgagtttgggaggctctgctttcctccttaggacccactttgccgtcctggggtggctgcagttatgtccgcgctgcgacctctcctgcttctgctgctgcctctgtgtcccggtcctggtcccggacccgggagcgaggcaaaggtcacccggagttgtgcagagacccggcaggtgctgggggcccggggatatagcttaaacctaatccctcccgccctgatctcaggtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatgataacccggaccctggtggctgcccgagcctttgtgcagggcctggagactggaagaaatgtggtcagcgaagcgcttaaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctggatggtctcctgatcctggctgataagct

SEQ ID NO: 8718 - DNA, 798 bp, Homo sapiens
  ENST00000490629
ctctcggctgcgagacttctatggggaatctggtgaggggttggatgacaccctggcggatttctgggcacagctcctggagagagtgttcccgctgctgcacccacagtacagcttcccccctgactacctgctctgcctctcacgcttggcctcatctaccgatggctctctgcagccctttggggactcaccccgccgcctccgcctgcagataacccggaccctggtggctgcccgagcctttgtgcagggcctggagactggaagaaatgtggtcagcgaagcgcttaaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctggatggtctcctgatcctggctgataagctccagggccccttttcctttgagctgacggccgagtccattggggtgaagatctcggagggtttgatgtacctgcaggaaaacagtgcgaaggtgtccgcccagggtgactgtgtgaggtctcttcccggtgccgcaggtgtttcaggagtgcggcccccccgacccggtgcctgcccgcaaccgtcgagccccgccgccccgggaagaggcgggccggctgtggtcgatggtgaccgaggaggagcggcccacgacggccgcaggcaccaacctgcaccggctggtgtgggagctccgcgagcgtctggccc

SEQ ID NO: 8719 - DNA, 787 bp, Homo sapiens
  ENST00000486702
gatggtctcctgatcctggctgataagctccagggccccttttcctttgagctgacggccgagtccattggggtgaagatctcggagggtttgatgtacctgcaggaaaacagtgcgaaggtgtccgcccaggtgtttcaggagtgcggcccccccgacccggtgcctgcccgcaaccgtcgagccccgccgccccgggaagaggcgggccggctgtggtcgatggtgaccgaggaggagcggcccacgacggccgcaggcaccaacctgcaccggctggtgtgggagctccgcgagcgtctggcccggatgcggggcttctgggcccggctgtccctgacggtgtgcggagactctcgcatggcagcggacgcctcgctggaggcggcgccctgctggaccggagccgggcggggccggtacttgccgccagtggtcgggggctccccggccgagcaggtcaacaaccccgagctcaaggtggacgcctcgggccccgatgtcccgacacggcggcgtcggctacagctccgggcggccacggccagaatgaaaacggccgcactgggacacgacctggacgggcaggacgcgggtgagacccctgcatccctgagcctgagccccgcccactgccctgaagcctctcccctctcctggtagttcccgcccgtgcctctgctcttagcgttcattgattaattcactaattcattcaacgagcatttattgagcgttgccctgaaagactgggggtaacagatcaatgagggggtctgtatccttt

SEQ ID NO: 8720 - DNA, 2532 bp, Homo sapiens
  ENST00000292377
ggcagatgccgcctggtccagctatcgtgctcggtattcagttttccggagcagcgctctttctctggcccgcggagcggtcccgcggccgagtaccggattcccgagtttgggaggctctgctttcctccttaggacccactttgccgtcctggggtggctgcagttatgtccgcgctgcgacctctcctgcttctgctgctgcctctgtgtcccggtcctggtcccggacccgggagcgaggcaaaggtcacccggagttgtgcagagacccggcaggtgctgggggcccggggatatagcttaaacctaatccctcccgccctgatctcaggtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatgagttttttctggagatgctctcagtagcccagcactctctgacccagctcttctcccactcctacggccgcctgtatgcccagcacgccctcatattcaatggcctgttctctcggctgcgagacttctatggggaatctggtgaggggttggatgacaccctggcggatttctgggcacagctcctggagagagtgttcccgctgctgcacccacagtacagcttcccccctgactacctgctctgcctctcacgcttggcctcatctaccgatggctctctgcagccctttggggactcaccccgccgcctccgcctgcagataacccggaccctggtggctgcccgagcctttgtgcagggcctggagactggaagaaatgtggtcagcgaagcgcttaaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctggatggtctcctgatcctggctgataagctccagggccccttttcctttgagctgacggccgagtccattggggtgaagatctcggagggtttgatgtacctgcaggaaaacagtgcgaaggtgtccgcccaggtgtttcaggagtgcggcccccccgacccggtgcctgcccgcaaccgtcgagccccgccgccccgggaagaggcgggccggctgtggtcgatggtgaccgaggaggagcggcccacgacggccgcaggcaccaacctgcaccggctggtgtgggagctccgcgagcgtctggcccggatgcggggcttctgggcccggctgtccctgacggtgtgcggagactctcgcatggcagcggacgcctcgctggaggcggcgccctgctggaccggagccgggcggggccggtacttgccgccagtggtcgggggctccccggccgagcaggtcaacaaccccgagctcaaggtggacgcctcgggccccgatgtcccgacacggcggcgtcggctacagctccgggcggccacggccagaatgaaaacggccgcactgggacacgacctggacgggcaggacgcggatgaggatgccagcggctctggagggggacagcagtatgcagatgactggatggctggggctgtggctcccccagcccggcctcctcggcctccataccctcctagaagggatggttctgggggcaaaggaggaggtggcagtgcccgctacaaccagggccggagcaggagtgggggggcatctattggttttcacacccaaaccatcctcattctctccctctcagccctggccctgcttggacctcgataacgggggaggggtgccctagcatcagaagggttcatggccctttcccctcctcccccctcagctgggcctggggaggagtcgaagggggctgcagagagggtagagaagggactttgcaggtgaatggctggggccccaaatccaggagattttcatcagaggtgggtgggtgttcacaatatttattttttcatttggtaatgggaggggggcctgggggtatttatttaggagggagtgtggtttccttagaaggtatagtctctagccctctaaggctggggctggtgatcagccccaacagagaaaatgaggagtttagagttgcagctggggaaggggtttgaaggaagttggaagtggggaggggtgggggcatctggtctcagaaatggaccagctggatgcagggcaggggactgagggtgcttgagtaggatgtgagacttcatgggcctgggttctgttgagttttttcagtatcaatttcttaaaccaaattttaaaaaaaacaaggtgggggggtgctcatctcgtgacctctgccacccacatccttcacaaactccatgtttcagtgtttgagtccatgtttattctgcaaataaatggtaatgtattgga

SEQ ID NO: 8721 - DNA, 6467 bp, Homo sapiens
  ENST00000377047
ccaggatttctctcttcctatttcaggaggactctcacaggctcccacagcctgtgttaagctgaggtttcccctagatctcgtatatccccaacacatacctccacgcacacacatccccaagaacctcgagctcacaccaacagacacacgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggggaacacttaagaatctgtcctcaggaatatacatgctgcaccacagaaatggaagacaagttaagccaacaaagcaaactcgaatttgaaaaccttgtggaagagacaagccattttgtgcgcaccacttttgtgtccaggcataagaaatttgacgaatttttccgagagctcctggagaatgcagaaaagtcactaaatgatatgtttgtacggacctatggcatgctgtacatgcagaattcagaagtcttccaggacctcttcacagagctgaaaaggtactacactgggggtaatgtgaatctggaggaaatgctcaatgacttttgggctcggctcctggaacggatgtttcagctgataaaccctcagtatcacttcagtgaagactacctggaatgtgtgagcaaatacactgaccagctcaagccatttggagacgtgccccggaaactgaagattcaggttacccgcgccttcattgctgccaggacctttgtccaggggctgactgtgggcagagaagttgcaaaccgagtttccaaggtcagcccaaccccagggtgtatccgtgccctcatgaagatgctgtactgcccatactgtcgggggcttcccactgtgaggccctgcaacaactactgtctcaacgtcatgaagggctgcttggcaaatcaggctgacctcgacacagagtggaatctgtttatagatgcaatgctcttggtggcagagcgactggaggggccattcaacattgagtcggtcatggacccgatagatgtcaagatttctgaagccattatgaacatgcaagaaaacagcatgcaggtgtctgcaaaggtctttcagggatgtggtcagcccaaacctgctccagccctcagatctgcccgctcagctcctgaaaattttaatacacgtttcaggccctacaatcctgaggaaagaccaacaactgctgcaggcacaagcttggaccggctggtcacagacataaaagagaaattgaagctctctaaaaaggtctggtcagcattaccctacactatctgcaaggacgagagcgtgacagcgggcacgtccaacgaggaggaatgctggaacgggcacagcaaagccagatacttgcctgagatcatgaatgatgggctcaccaaccagatcaacaatcccgaggtggatgtggacatcactcggcctgacactttcatcagacagcagattatggctctccgtgtgatgaccaacaaactaaaaaacgcctacaatggcaatgatgtcaatttccaggacacaagtgatgaatccagtggctcagggagtggcagtgggtgcatggatgacgtgtgtcccacggagtttgagtttgtcaccacagaggcccccgcagtggatcccgaccggagagaggtggactcttctgcagcccagcgtggccactccctgctctcctggtctctcacctgcattgtcctggcactgcagagactgtgcagataatcttgggtttttggtcagatgaaactgcattttagctatctgaatggccaactcacttcttttcttacactcttggacaatggaccatgccacaaaaacttaccgttttctatgagaagagagcagtaatgcaatctgcctccctttttgttttcccaaagagtaccgggtgccagactgaactgcttcctctttccttcagctatctgtggggaccttgtttattctagagagaattcttactcaaatttttcgtaccaggagattttcttaccttcatttgcttttatgctgcagaagtaaaggaatctcacgttgtgagggttttttttttctcatttaaaataaaaaaggaagaaagaaaataattttccttgtaaaatcgggccaaaccccaagacagctacattttcaacaaaaaagcaaacagagaaaaataaatgaactttaacactgtaagttcagcattgacagccaacttccagtgtaagcttttttgtgacaaatccgggtttaaaaatgcttatggggagaaagcttaaagtttgttctaaatgtagtgaaaatgcactgttgtcttggaggtatcatcttgcactctaaccaaacaacaccaaattaatctggaggtactgatactaaatttggaatcccgtctttaatatgagaacacaaattactacaactcagtacctctgtcttactctgcccaatttcaatttagtaatggcaccattattcttaattcccttaatgtctgtccgctgtatccaattggcacagattttccccttcatcttcaattactagtagctacccccatcaattcaccttcctcaagagtctcaattgaaaataatctttgatgatacaatctctgcttttgccacaggtttgacattaactagacgtttctgcccctgtgctcattaccctcccaaaacaatagtttttttaatgaattgaaacacaattagatccattcctgagttttcatttttaactatttactttgtgtcagttggtttctgcatcacaagggcattctcttacaaaacaactcacaacagaaaaaaaaagtcaagacaaaaaatatatatatatagtattgacatggagatttctttcacttttttagtcttagtatgatcatctatttttatatctatgtatatataaatcacagattttaacttcttaattccaagctcagggttgacacacctttgtaagaaaatgttttgtcaaccagctcttcttgttttgtgctgctcaaagaagggattcctcagtgatcggtgagcaccaagaatcaagaaagagaactttttatgtatctaactgtccatttattaaaaatttgccagggcacacccttctgcatgagtgtgcttcagcctgggtgctccagactacaccaaactcatgggatgagccattggtgtgcagggctttaccggtgatggaaactgtatgtgtaaagaatgttattcatgaaaaaccattgctttcatgtaaaacaccttcggcctaggattcctgcctggcacttggatacattacctaactcaataggccagtttagagccacagcctaacctgttcaccaagtaggccaaagccaggcctttcgctccccctgacagagagaagcaaaataaacccaactgggggctttatgaatacagttggctatccatatgtttcttagtttttatgatgcatctggagtagggaaaagtaatgtttcaagacaccatagtaggccagttacattttaattaactcatcgacagtattgacacgtaaatggtatttttcaatctgttctcatcaaaattaaaattagttattgatttagtcatcacatttaagtagaacacatgtggcacaatagtattaagtatatttgagcacttttgcaagacagaaagtatttacaagcatctattgctactttatgcctaatgaaatataaaatgtaggatgatgagagactttgtggcattctttcatttaaacctttatgaaattaaccatctagttcatcattacatactcctagaaaaccatccatttcactgcccacattttggcttcctaccacaaattccacataagacttctctatgaaggaccagtcatttacattgctcatttcattctgtgttcagaagtcagtattgtctttctccaataattaaggtgcaatacaaattaaatcaaccttgattttccagactatttgaataataacttgcttttatggctttaaactccaggtctttcctttttaaaatatttctgcattctcttttatgaactagatcaggatgccttgtttttcctgtgctttcacccccaaaaggttttgtgcatgtgtatgaatacacataatattagtgaatgtgaacccatgttctatacgcactaaacacacagttaatatataaacgcctgcttcatttgtttcaacaccttcattatcaatatgattcatattgatgagatatagtgatgcataatgagccaggcagagagctgaaatgatatcagttaatgatgtcacagtgttagcaccctgcatggatgtggtcaaaatatcattcaagttgtacttcctagtttttatcatcatactactatgtcatatgattttcagactaatttaacatgagaaatgttttggccctaaaggatttcacttaacctagttaccctatttcagtaagtattttggaattcaaccctcgaattattttttctcatttcagcatagtgataggggatgcaatgaggcttcattattttttatgacctgcccctcatttgctctgatgttccctaaattctgtaatcatatcataacttttgttatgaatagagaggaatgggctcactgaaacctgacactagaaattggtgggtgatgctcataactgcaaacacttagcttattgaagtgcctctatttacatgttctttagttataatatgtatttttctaacagaaatacacgtctgtaattggtatatattatactttgtatgtgtcacaacaaaagctaaacagaggctaaagtctttagcagagaagaatgaattacaaatttaccaataagagctctgtttatggttctgtattgaaggacaaccatgacaaccttctgtcattttcacgaaggccaagttggtactttgattatagccatcgtagaacattagcactagaaatctgtctcccttacaatgacttacctagctagcatcaagtaacttgtatcacctgctttaaatgtaagggatagaaaatactattttgtctacactgaaaaacattattattcattgataagtagtaataattataaaagtaacattctttaaagcaaacacattgaaaatattattacaggcagaaccctgatttttaatttatattccctgctgcagacattagccttctttaattcttttgccattacatacatgtttcggctacagactgaacacgaactaaagtccctaaggaggaaaaaaccttaacatattcctgagatgtgattcttttattacttctttttgcaaagctaattatcaaatgatttgattaaacctagacgcattaggaaatgcaagttttacctaaaacttgcagaaatttaaacacatttccatttacttactaacgaacagacctgatttttatttaaaaacacaatttagctttgccaacagaagagtaaaggaaaccataacttataaatttgtaatgtgttcctccttgttggagacattagccagtgtttagttttagaccaacttatacaaagagagtattgatttgtacacattctggagacttgctatatcatggtttgctatggcacagactcagcttagcatggggacattttgaacttcattcaaagttgagtagttactggaacctttgacattgccttgtaatgaggtacttccaaaaaaagacccctaacaatggcataatagtgaggtctctctgtgcatatacataatatatatgcaggataaatgtgtgcaccaatcaaatctaaaattttatgtgactgtcaaatgaatattatttgggttaagatttttcatttctgatttggatagaaaattgctattaatcttgtattaaaatagtttttaaaaatcta

SEQ ID NO: 8722 - DNA, 792 bp, Homo sapiens
  ENST00000617456
gatgcaatgctcttggtggcagagcgactggaggggccattcaacattgagtcggtcatggacccgatagatgtcaagatttctgaagccattatgaacatgcaagaaaacagcatgcaggtgtctgcaaaggtctttcagggatgtggtcagcccaaacctgctccagccctcagatctgcccgctcagctcctgaaaattttaatacacgtttcaggccctacaatcctgaggaaagaccaacaactgctgcaggcacaagcttggaccggctggtcacagacataaaagagaaattgaagctctctaaaaaggtctggtcagcattaccctacactatctgcaaggacgagagcgtgacagcgggcacgtccaacgaggaggaatgctggaacgggcacagcaaagccagatacttgcctgagatcatgaatgatgggctcaccaaccagatcaacaatcccgaggtggatgtggacatcactcggcctgacactttcatcagacagcagattatggctctccgtgtgatgaccaacaaactaaaaaacgcctacaatggcaatgatgtcaatttccaggacacaagtgatgaatccagtggctcagggagtggcagtgggtgcatggatgacgtgtgtcccacggagtttgagtttgtcaccacagaggcccccgcagtggatcccgaccggagagaggtggactcttctgcagcccagcgtggccactccctgctctcctggtctctcacctgcattgtcctggcactgcagagactgtgcagataa

SEQ ID NO: 8723 - DNA, 5489 bp, Homo sapiens
  ENST00000379019
agtttggtctggagcagctgaaaccggtttgagcgtggctgcttcctgccgctcgacgccgcggcaggccgcctggggggagcgctggcgaggcacggacggcgggcgcccggtacctctgcccgcggtcctcgctctcgggcggggcggcggcgacgcggacctgcggactagcgaacccggagcacgacatcataaaataaatccatcagaatgacaccttctcaggttgcctttgaaataagaggaactcttttaccaggagaagtttttgcgatatgtggaagctgtgatgctttgggaaactggaatcctcaaaatgctgtggctcttcttccagagaatgacacaggtgaaagcatgctatggaaagcaaccattgtactcagtagaggagtatcagttcagtatcgctacttcaaagggtactttttagaaccaaagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccttgtggaaacttcaggaaggatgaatccgtctttgtgctccacggctcgtaccttgatcaggctgtgcatcacagtaattctgttctaggtaggcagagttgatctttgtctcatctgccaggctgcaggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggcaacaatcctagtttcctaactcagattgtttcacgataaa

SEQ ID NO: 8724 - DNA, 4015 bp, Homo sapiens
  ENST00000418646
ttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaatctgtggttcaggaggaaaattccttttcagaaaatcagccatttccttctcttaagatgggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccttgtggaaacttcaggaaggatgaatccgtctttgtgctccacggctcgtaccttgatcaggctgtgcatcacagtaattctgttctaggtaggcagagttgatctttgtctcatctgccaggctgcaggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggcaacaa

SEQ ID NO: 8725 - DNA, 6649 bp, Homo sapiens
  ENST00000481038
aacaacagtttttaattgcctcttaaaataaactttattagaaatatttacctagatatttttgttttcttgggttagattagtttattatgaaatattcactttcatttggaatggttaggaagtttataagataccattcttcttgactgagcatccatagctctatttgtttacttgctcaggcttaacgaacatttgaagaaaaaattaatccaaaacaaagattcttaaatttttaactttgaatattaatagagtaagttattctattttttcttttcttcttaatttttttaagagaaattggtaaatacttgaataaacttgtatgaatgaattcaaatttcttaaattccctattggctatgctagaattgctacttggaaagttttcttttttttttttgtctttttttttttgtaagttgttttcttttaaacacattaacttttcttatgcttaaatatggcatttctcttcatacaagtatttttgaatttcttagtccatattgaaaatcgaatttgaagttcacttcacatacattaaattacccacatgtattcatctgtaaattgactcagtgctgagaaatgtatcttttagtttctaggtaaagttaaaattgaaagataactggatgccagttttctggtttaaattagaaagcagtgggagtttctgctttatcctggagtaaggacacatctcatttaaacagtatctcattccatcctctttattggattttctttttgtatgttttaatacatttttgatagtgtatttaggatttttatgagagtatacttaaaattataatattcccatactgaggttggaacttactaggtattgaatgttttaaaaaattgtattttaaagcatcttgcagttaaatatattttattatgagaagtgggatgattttgtttctatcttttagaaaggaatgtatacttttgagaaatataacttttgaacttaaaagctgtgtgaaacttaccagagaatctttactaggaactgtcacatccattttgcaagtatttcagactaacgtttaaagtaaactgggaagggaagtaggccaggaagataaattgtattttactcaaagggtggggttttacagcttttctcattgagttgaaatttctgttaggagaaggggttgtgctagcgtttattcttttggtagttcctcacagctctgtacatacaggtaagttcacgctgttcgtaaagcttttaactggcagtagtgaatagttgggatatgaggagaattacatttgagacaagttcagaatatgcactacataagaataagcattttaattgtgccaagacctttggtttgaaaatcaagaaggagttatcgttgtccagcaacctgtgagtcttgtacattggttagtgtagaagttaatcccagtgcctctagagcacctttctgaagagttttctttttcttctttttaacataatggacaatcaacgaagtatgtaagaaccattactgtttgctagcctcctttaaagggaattctttattgagggctacaataaatatgcttattcaccttgggctgcttttaagctgtagatttaatattataaacgatctttaaggtgggtaatttctcagttgttcactgggtatgcatcaagagttttaactaaattttctattttccttaaattctagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccttgtggaaacttcaggaaggatgaatccgtctttgtgctccacggctcgtaccttgatcaggctgtgcatcacagtaattctgttctaggtaggcagagttgatctttgtctcatctgccaggctgcaggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggcaacaa

SEQ ID NO: 8726 - DNA, 633 bp, Homo sapiens
  ENST00000462080
aggaggccatcttttctctgctgatgggtagtgccagtgtcaggtcaccagaggctctttcagagttctccactctggacgtgtctgacgttattgagcagctttagagtagttcccacgctggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagc

SEQ ID NO: 8727 - DNA, 571 bp, Homo sapiens
  ENST00000633552
agaaaatactattgcttctttaagaaatgctgctagtcatggtgcagcctttgtagaatttgacgtacacctttcaaaggactttgtgcccgtggtatatcatgatcttacctgttgtttgactatgaaaaagctgtcttcagcgctacagctttctgccagctgcattttccttccagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggca

SEQ ID NO: 8728 - DNA, 342 bp, Homo sapiens
  ENST00000473797
tcacagccatagtcatattttggggatgtcaaaactggcctcagaatacagaataagtaccatttcccattgttgaaagtacactttgcttctttattacatttgtttctttatcttctctatagtctatgttaactgtatttcttcttttcaggctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccag

SEQ ID NO: 8729 - DNA, 819 bp, Homo sapiens
  ENST00000481690
cgggcgcccggtacctctgcccgcggtcctcgctctcgggcggggcggcggcgacgcggacctgcggactagcgaacccggagcacgacatcataaaataaatccatcagaatgacaccttctcaggttgcctttgaaataagaggaactcttttaccaggagaagtttttgcgatatgtggaagctgtgatgctttgggaaactggaatcctcaaaatgctgtggctcttcttccagagaatgacacaggtgaaagcatgctatggaaagcaaccattgtactcagtagaggagtatcagttcagtatcgctacttcaaagggtactttttagaaccaaagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccacca

SEQ ID NO: 8730 - DNA, 4193 bp, Homo sapiens
  ENST00000315266
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccattcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattattt

SEQ ID NO: 8731 - DNA, 4297 bp, Homo sapiens
  ENST00000478722
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccattcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagaagcatccattctacaccagtcctgctgttgtcatggcacacggtgaacagcccatccctggtctcatcaattattcccatcattcaacagatgaacggattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattatttaaaaa

SEQ ID NO: 8732 - DNA, 1723 bp, Homo sapiens
  ENST00000459628
gtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaagaaattcccaacattcccattttgtgggctccagaaaggggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagaagcatccattctacaccagtcctgctgttgtcatggcacacggtgaacagcccatccctggtctcatcaattattcccatcattcaacagatgaacggattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgaggtactattatatttgaccattgccctttcttttcttcatttttttccaaataagattcatgtaacattaatgcacagttttcctgaaaaagaaagattattaaccattattacagttatcatcattctttttttttcttatttctactcaataagaaaaaggctaagggttcagccttaacagtatacagagtaaaatccatgaaactgccttttcattaaaaaaaggaaaaaaaaaaaaaaa

SEQ ID NO: 8733 - DNA, 2459 bp, Homo sapiens
  ENST00000543237
agtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagagaaattcccaacattcccattttgtgggctccagaaaggggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagattccagactccatcatttctcgtggtgttcaggtgctcccacgagacacagcctccctcagcactactccttcagaatcgcctcgtgctcaggctacatctcgcctctctacagcttcctgcccaacaccaaaacaaattagacggccggatgaaagcaaaggagttgctagtagagttggatccctcaaagctcggcttccctcgtgctcatctacctatagtgtatctgaggtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttccc

SEQ ID NO: 8734 - DNA, 550 bp, Homo sapiens
  ENST00000555668
gcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgggataaattccaaaactgccagtgaatggctgaaaccacagatactactgaacccaagtactgcgataccacaatagctgatctgataacccagatggctggttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagagaaattcccaacattcccattttgtgggctccagaaaggggccacaaaagaagtaatagaacgggaagcaccagggatggccctggcaatgctgatgggatcacttaatgttacacctctgggcatgctctcta

SEQ ID NO: 8735 - DNA, 512 bp, Homo sapiens
  ENST00000556633
gcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaactt

SEQ ID NO: 8736 - DNA, 503 bp, Homo sapiens
  ENST00000557654
gcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgggataaattccaaaactgccagtgaatggctgaaaccacagatactactgaacccaagtactgcgataccacaatagctgatctgataacccagatggctggttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctag

SEQ ID NO: 8737 - DNA, 574 bp, Homo sapiens
  ENST00000553936
gcgctgggaaacatggcgaccgagggaatgatccttactaaccacgaccatcaaatccgtgtcggagtccttacagtagggatggagtttcaccgtgttagccaggatggtctcgatctcctgaccttgtgatccacccatctcggcctcccaaagtgctgggattacaggcgtgagccaccacgcccggccagcagtaaggtatttttaaattaagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctca

SEQ ID NO: 8738 - DNA, 562 bp, Homo sapiens
  ENST00000556020
agtatctgtgcttgcctggacgagactcaggtgttaatcagatgaaactgctcctcctcgggttgtccctcgcgggccgggcgtcccctcagccacccatggggcacccttcgcctccctcgggggatgggggatcggcttgcgtccggacctcggaaagtgtctgccttctgcctttccgcgcaaaaggccctctgtctgcctcgtcgtttccttagcgaggacgggctgcagcctgctgccggggatccagctttttacttgagagggcaggattcccctactcgggctcctctccccctcctttctgggaacccccaccccggtagagcgtcccgaggctgtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagat

SEQ ID NO: 8739 - DNA, 2514 bp, Homo sapiens
  ENST00000544752
aggttcaagtgattctcttgcctcaatctcctgagtagctgggactacaagcgcgctccaccatgcttggccaatttttgtacttttagtagagatggagttttgccatgttggccaggctgttctcaagctcctgaccttacgtgatccacccgcctcggcctcccaaagtgctgggattacaagcatgagccactcacccagctggtttttttatataccagaaagaatagagagctatttataagagaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagaagcatccattctacaccagtcctgctgttgtcatggcacacggtgaacagcccatccctggtctcatcaattattcccatcattcaacagatgaacggattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatctttt

SEQ ID NO: 8740 - DNA, 841 bp, Homo sapiens
  ENST00000555456
gaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagattccagactccatcatttctcgtggtgttcaggtgctcccacgagacacagcctccctcagcactactccttcagaatcgcctcgtgctcaggctacatctcgcctctctacagcttcctgcccaacaccaaaacaaattagacggccggatgaaagcaaaggagttgctagtagagttggatccctcaaagtccagtccaggtgcagcagcaaggagaacattctcagagccagtcacagtgctgtcgatatcaccaaggtggctagaagacatcgcatgtctccttttcctctgacatctatggacaaag

SEQ ID NO: 8741 - DNA, 435 bp, Homo sapiens
  ENST00000556501
gtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatgtacgtcatcaccaagtcttactgtgct

SEQ ID NO: 8742 - DNA, 493 bp, Homo sapiens
  ENST00000555527
atcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaagcttgccaacaacatttgcaactttggatattgatggtgtaagaaaaataatctttgcactacctgggaatcctgtatcggctgtggtcacctgcaatctctttgttgtgcctgcactgaggaaa

SEQ ID NO: 8743 - DNA, 655 bp, Homo sapiens
  ENST00000555503
cacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaagggtaatgctttctaatgaccagaaaccaaaatggaagcctggtaacagttagggatatgatttcctaactgtccaaaataaacatctagagttttctatta

SEQ ID NO: 8744 - DNA, 592 bp, Homo sapiens
  ENST00000557678
ttgccttggattcctaggacatctgactttagtactaaaacaggaatattcctaggcaaaccaggatagttagacatcctccaacatctcattgtctcctttcattatagtggcttgttagaataaaaagccctgtgaaatcgccagtagccactacttcagcatgtacaaggtcctttctccataataagacttaatgctcctgttaggcagagacccttttgattcccacttcatacagaatatagtgctgtactcatgttaatgcctattagtgaataaggcgatgtagttttaagttggcactatatctaaaatcttttccttgtgtgttaatttctttgtctttatttttttccagcccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctggtaa

SEQ ID NO: 8745 - DNA, 404 bp, Homo sapiens
  ENST00000556240
gattgttgatgctacctccaaagacagaacatgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatca

SEQ ID NO: 8746 - DNA, 793 bp, Homo sapiens
  ENST00000465673
agagtgatctcttggcaatagttaagcaatcaaacggagctatagtaatggcttataaccaaagtacacaatcagtgtcaaaaagaaagacagggatgtgaacacacaggttcccaggagacgcggagccagaacttagcatgggatcccagccctgcatttctcaactttttttcagtctgtgactttggtgggatctgtctccccactctttgcctgtcctgctctgaccatcccatctgacccaggatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcct

SEQ ID NO: 8747 - DNA, 721 bp, Homo sapiens
  ENST00000492858
atagtaatggcttataaccaaagtacacaatcagtgtcaaaaagaaagacagggatgtgaacacacaggttcccaggagacgcggagccagaacttagcatgggatcccagccctgcatttctcaactttttttcagtctgtgactttggtgggatctgtctccccactctttgcctgtcctgctctgaccatcccatctgacccaggtatgaacacagagtccatccacgcagtcctccccaagaggaacttggaggaagtaggggccatggatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttc

SEQ ID NO: 8748 - DNA, 2862 bp, Homo sapiens
  ENST00000258733
ttgaatctagtaaatgtggaatcacaaaattgaaataatgtgcatctgaaaagtgaataaatagatgccaagaaggagtgagtcataagcacatgagttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaa

SEQ ID NO: 8749 - DNA, 2763 bp, Homo sapiens
  ENST00000381990
tgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagaca

SEQ ID NO: 8750 - DNA, 1673 bp, Homo sapiens
  ENST00000409458
ccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggttggcttttacaaacccctaagcttcttctttacctttccttaaaatttcaaccttctcttttcttactctataattgagaatgataacacagagagttaataacagtcaccctgctaactttccttagcatgagtgaacagtgagagataaaaatgaaatcttggttaaccttgccaaatctccaggacaccgaagagttaaaaagagagaaaaacaaaaagattaagctctttttcaaaaaaacaaaaccacttaatttttttctacctaaaaccataacaagaaaaaatgctaacacttatttatttgaatggcacatggagaccgggcatgtggctcacacttgtaatcccagcaccttggaaggcggaggcgggtggatcacctgaagtcaggagttcaagaccagcctggccaacatggtgaagtcccgtccctactaaaaatacaaaaattagccaggtgtggtggtgcgcacctgtaatcccagctactcaggaggctgaggcaggagaatcacttgaatccgggaggtggaggttgcagtgagaggagattgagccattgcactccagcctgggcaacagagtgagactccatctcgaaaaacaaacaaacaaacaaaaaacagaatggcacattgatgagcattcattgattgattctttagtttttttatgttctctaaagaatttttaagatttaaagaagcatgtgctatttatttgtaggaaatcctcagaaaaggtacaaataaaaaataaaaattatccataattaataccagagattataattgttaattattatggtgttttctttgctagtatttaagatcattattaagatcacatacacatttttgcttactatcattagcatttgatgatatgatttttttaatttttatacattgttttaatggctgcacgatatttcattgtgtacaaataaaataactactgttccgctttgaccta

SEQ ID NO: 8751 - DNA, 577 bp, Homo sapiens
  ENST00000459927
acagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgagaccccgcggccgcgccctaaccctcagtctcccgactgcgactgcgacccgggaaaacgcctacgtttttggaaaggaagtcccatcacagggagctgacccggtgtcagcgcgcagcacgttcccggcccgcagtgcgccgcgcgtcctcctagcagcccgcggagcccggcactgtgatggtcccgcttcccacacgaggccacgggccacagagtgggcaaggaactcgccccaagccacacagcggatctgaggaagaggaagactctctggaacagtggaaagaacttgtccttgtcctgggaatcaaaagatgtgaatcttgatttctactaaagatgaccctaggatttcatgatgtgctgggcaatgaaagaccttctgcttacatgagggagcacaatcaatt

SEQ ID NO: 8752 - DNA, 577 bp, Homo sapiens
  ENST00000487890
agatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacatctgaggaagaggaagactctctggaacagtggaaagaacttgtccttgtcctgggaatcaaaagatgtgaatcttgatttctactaaagatgaccctaggatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctga

SEQ ID NO: 8753 - DNA, 513 bp, Homo sapiens
  ENST00000474157
cagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacaggttggactgaagttcttcaggaagctttcatctctggctcactcatctcttcttctgcaaactgttgggaaggctgaaactacagcaaaatgcctccagctccattctttgctttcggctcatggaaagtaaaaactatgctgcccttctcttgtgaagcttcttttccattgcaattgcaacccattcttgccagacagtggttgggggagggttggacagcctccggccacagaacaaagcaactccaccaactaaactatgtccagcttccatccaaaagggtggagacctcacatgaaatggggtctccaatctggaggcaaatttacgaatctccccagccctgaagctatt

SEQ ID NO: 8754 - DNA, 447 bp, Homo sapiens
  ENST00000492512
gaaatctgcgttttgattatgttcctggaaacaataactttctttcaagatctgaggaagaggaagactctctggaacagtggaaagaacttgtccttgtcctgggaatcaaaagatgtgaatcttgatttctactaaagatgaccctaggatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatg

SEQ ID NO: 8755 - DNA, 788 bp, Homo sapiens
  ENST00000479625
ggggtttcaccatgttagtcaggatgggctcgatctcctgacctcatgatctgcccccctcggcctcccaaagtgctgggattacaggcatgagccactgcacccggccagtttcaacgtcttatttgcttcttgtgttcacacaaaatgtgggattatgcttccttacataatttagcaattataataccttatagctctcacatctgtgtaaattatgacacatttagttcaaatttctatagcaatttcatagtatagtgttcctgatatttttctaaaaagcaaatggcaaatgtttagattttttattatatcacatgtatcttttatgttcgtagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagag

SEQ ID NO: 8756 - DNA, 538 bp, Homo sapiens
  ENST00000470994
gatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaagtaagtttttggttcctacgctttatatcactatagtgtattgtcaaaagtgaatatatctctgtgtaaataggcatttttcccttttttgcttttaaacattttgtgtaggggaggaaaatattacattgaatggtgaataccaaactggcctgttaatcttgttgtggtttgtttttaatcctaaaagatgctaccagatctcagtaactttacaaaattatgtcaacttaattttaacatgatagtctcaaattatagtaagcaggcacatttcttgcatgaacaagagtaaataaatgtactttcat

SEQ ID NO: 8757 - DNA, 378 bp, Homo sapiens
  ENST00000463011
atgagccggggaagggcactcctgtaagggggcacggaggtctgaaagagcacggggagtatggccaactttcaggatttttagcacagctagaagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcactt

SEQ ID NO: 8758 - DNA, 862 bp, Homo sapiens
  ENST00000478451
aggtgtctccaggacgtgacatctctcccccgcgcccttaccacagtgttccagacatgctgactcattctctaaatagaagataagctgacccaaagactatacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatga

SEQ ID NO: 8759 - DNA, 808 bp, Homo sapiens
  ENST00000468723
ctcccccgcgcccttaccacagtgttccagacatgctgactcattctctaaatagaagataagctgacccaaagactatgtattatttaatagaaaagattactgaaagcccagagggagccatatatcttctgtgacggctcccttcctcatttatttaatggcattataagcggcatgtcctctaggtggaagacataactaacatgctcttgcttctgttttaagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattag

SEQ ID NO: 8760 - DNA, 7353 bp, Homo sapiens
  ENST00000372406
attattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaaggtgacagcatgggacctcttcagcagagagcgaatctaagagcaggaagtcgcatagagtctcaccattttgcccaggctgatcttgaactcctggcctctagctgtcctcctgcctcagtctcccaaagggctgggattacagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaa

SEQ ID NO: 8761 - DNA, 7209 bp, Homo sapiens
  ENST00000347136
attattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaa

SEQ ID NO: 8762 - DNA, 2833 bp, Homo sapiens
  ENST00000493417
gctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgtgtaagaaatctttcttccctcttccttagccctgacccctttgcctaacacaaagcagcacagtgtgaatcgggtcggctgctctcagcatttcgtggctgcaggggtggttcctctatttttagcagaaggaagcggacactggagccccaggctgtctgatctggtttgaagtacagtatctgccaaacctagctgggtcttgtcagggaagatggaacttgccgttccactaagcatcattggagcctgctttcaagaactcagtggcaagaacttaggaatatacgtggccagttcacgagggagaacagggggccgactttctgtcaggcccgccatcaggcgcttacgtctgaaaatggaatcttctgagtcatctctaagtctgctaatgatcctcagacatcctctatcgtcagataactgcgtggcttttcacagcacaatgactttgacctatatctgagcactaataggggcttttctgagtcacacagtgaatgactctagggtcctattttctgggaaagggccatcattgtctagaaaaatgagtagtgattaagcatatttgcttgttaactgaaatttgataagccaggtcaatgctgtgtttgatgattagcctaaggcagagttttcccttcttggttcactggtatcaagtgttctgcccccagccctggcagcctttgaattcttcccaattcagaggctgagactcggcccatgctaagctctgcttggctgtcagcgggtcaggcagcatgggacagctctctctgctcagctccacggcaacagtaaaggaaggcaggtcctgccagcgggcgccaaacagcatctccccatgcagaggaagaaacacctccttctaaacagtggagaggagtgcaggaggcccatcagctgtgcctttcccagaagtggcaggatctgagcaagtgtctgttggttgaagaggcacacatgtcaggctggcaaccagcagcatcaggaaataacctaagacgcggtgtgtttatcattcccctgctgggagcctttggcttggtccgtccgcataacacggggttctttgggtaggcagctagaagccgagcggccgggtcgcagcatcgtctcctttactgcattgtactccacagtcgtaatgggaggttcccgcttcccacatcctttccctcagccgttacatcttggagcctggatgcattatgaaggtatttttgtttcgtggcaacaatttttttaaaattt

SEQ ID NO: 8763 - DNA, 389 bp, Homo sapiens
  ENST00000462907
taagctagaatatccagaaatgaattctgttgttactattaccggttactagataccatttataatataacaaggtctaatttgctgcttcgacagtacaagaattatgttttgggacctgaggaaatggcagtccccaagattattttgtttaattatttgatattagacaagctgaagcctcataaaatgatactgtaatatatatatgtatctgtaagttgagtcatgcagcactctcttttaaatgttcttgcttctagatggtggaaagtctaaaagaagtacagtggattcaaaggccatgggagagaaatccttttctgttcataataatggtggggcagtgtcatttcagtttttctttaacatcagcactgatgaccaag

SEQ ID NO: 8764 - DNA, 177 bp, Homo sapiens
  ENST00000483935
catcagcaacagatggaaaaggtgacagcatgggacctcttcagcagagagcgaatctaagagcaggaagtcgcatagctgctattaacttagcaaagctgaaacttttcagacattattacgtcttgattgtgtgttacatatacttcactaggatcattgcatttctcctcaaac

SEQ ID NO: 8765 - DNA, 648 bp, Homo sapiens
  ENST00000415344
gcgggcgccaaacagcatctccccatgcagaggaagaaacacctccttctaaacagtggagaggagtgcaggaggcccatcagctgtgcctttcccagaagtggcaggatctgagcaagtgtctgttggttgaagaggcacacatgtcaggctggcaaccagcagcatcaggaaataacctaagacgcggtgtgtttatcattcccctgctgggagcctttggcttggtccgtccgcataacacggggttctttgggtaggcagctagaagccgagcggccgggtcgcagcatcgtctcctttactgcattgtactccacagtcgtaatgggaggttcccgcttcccacatcctttccctcagccgttacatcttggagcctggatgcattatgaagatcctctgcatctcatgacgggcttcctggcttccccgattccccggcagagggattcttctcagcccgagccatcaccgaacccggttcccagcactcctgtctctgttggaagtggctttgcagggttgctgtggaagaccatctcttctcctgggctgtgggctccgaagagcaataagaccacttctttttccttgatgacctagcatgaggcctgtcttgaagaataaaagttgttttctcacttg

SEQ ID NO: 8766 - DNA, 6991 bp, Homo sapiens
  ENST00000372410
tggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaaggtgacagcatgggacctcttcagcagagagcgaatctaagagcaggaagtcgcatagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaaccgtg

SEQ ID NO: 8767 - DNA, 2813 bp, Homo sapiens
  ENST00000610997
gaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaaggtgacagcatgggacctcttcagcagagagcgaatctaagagcaggaagtcgcatagagtctcaccattttgcccaggctgatcttgaactcctggcctctagctgtcctcctgcctcagtctcccaaagggctgggattacagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtagg

SEQ ID NO: 8768 - DNA, 2540 bp, Homo sapiens
  ENST00000481661
gccgagcccagctccccgcggcggccgctagcccccggccccgagccaccactccgacctagcggccgccgcccccggtgcgggatgaggagatccgcggccgccactgggccccatggaggagccgcagccgccccgcccaccagcgagcatggccttactgggcagccagcactccggcgccccctccgcggccggcccacctggcgggacttcctccgcggccacggcggccgtgctctccttcagcaccgtggcgaccgcggcgctggggaacctgagcgacgcaagcggaggcggcacagctgccgctcccggtggcggcggccttggcgggtccggggcagcgcgggaggcgggggcggcggtgaggcggccgctaggcccggaggcggcgccgctgctgtcgcacggagctgcagtggcggcccaggcgctcgtcctcctgctcatcttcctgctgtctagccttggcaactgcgcggtgatgggggtgattgtgaagcaccggcagctccgcaccgtcaccaacgccttcatcctgtcgctgtccctatcggatctgctcacggcgctgctctgcctgcccgccgccttcctggacctcttcactccgcccgggggttcggcgcctgccgccgccgcggggccctggcgcggcttctgcgccgccagccgcttcttcagctcgtgcttcggcatcgtgtccacgctcagcgtggcgctcatctcgttggaccgttactgcgctatcgtgcggccgccgcgggagaagatcggccgccgccgcgcgctgcagctgctggcgggcgcctggctgacggccctgggcttctccttgccctgggagctgctcggggcgccccgggaactcgcggcggcgcagagcttccacggctgcctctaccggacctccccggaccccgcgcagctgggcgcggccttcagcgtggggctggtggtggcctgctacctgctgcccttcctgctcatgtgcttctgccactaccacatctgcaagacggtgcgcctgtcggacgtgcgcgtgcggccggtgaacacctacgcgcgcgtgctgcgcttcttcagcgaggtgcgcacggccaccaccgtcctcatcatgatcgtcttcgtcatctgctgctgggggccctactgcttcctggtgctgctggccgccgcccggcaggcccagaccatgcaggccccctcgctcctcagcgtggtggccgtctggctgacctgggccaatggggccatcaaccctgtcatctacgccatccgcaatcccaacatttcgatgctcctagggcgcaaccgcgaggagggctaccggactaggaatgtggacgctttcctgcccagccagggcccgggtctgcaagccagaagccgcagtcgccttcgaaaccgctatgccaaccggctgggggcctgcaacaggatgtcctcttccaacccggccagcggagtggcaggggacgtggccatgtgggcccgcaaaaatccagttgtacttttctgccgagagggaccaccagagccggtgacggcagtgaccaaacagcctaaatccgaagctggggataccagcctctaagacggttggaatggccagcttatgaaggcaaatttccactcgcattatttaatgatggaagattctgggggagagttgtggatttcataaagccaaacatttaaagctagagacgggggaggcttaccactttccccaaacaacataaaagacaatgtcccttcttcaaaagtgccaaaaggaatgtaaaatgcaaaaattaaaacaatcttaaaccacataaccaagcattgtgaactgctatccaactatttagtggtagaactaggatttgaactgcagtctgtttggcctcagaactccatgtttgtttctctctatccccacagaagtctacagggcaacttcctgggagctaaggctactaaaaggtagaagccacagtactcatctgcagagggcttacagcctcagcaaggaccttgtggctttgtaacaacaatcagccataacaagtttacttgtggaaaagaaaaggtgtagcactttcagaagaggctatcaaagaaaagagatgaacttggaagcaagagatacgcagctcagcatgacagagactccattccaggtggaaaaagcacatggctctttcttctccgagatcccaggactatcttattttcctcagaggggcaggttacaagaacttcacatctctcaggctacatgttgcaaaggttaaattccaggttgtacgatttttcacttccaccatcaagttatgagtgtgattgtttccctgcagttttgccaatagagtgattttagactatttacatcgtgggttacaaccaatgtcagttattctggggaaacccaactgccatgttgtgaggacactcaagcagccctatggaggagcccacatggtgagtgaataactacaagctgactctaattttaaaaaataaaaattttatctctcaccaattttaaaatg

SEQ ID NO: 8769 - DNA, 4578 bp, Homo sapiens
  ENST00000395116
ggccgagcccagctccccgcggcggccgctagcccccggccccgagccaccactccgacctagcggccgccgcccccggtgcgggatgaggagatccgcggccgccactgggccccatggaggagccgcagccgccccgcccaccagcgagcatggccttactgggcagccagcactccggcgccccctccgcggccggcccacctggcgggacttcctccgcggccacggcggccgtgctctccttcagcaccgtggcgaccgcggcgctggggaacctgagcgacgcaagcggaggcggcacagctgccgctcccggtggcggcggccttggcgggtccggggcagcgcgggaggcgggggcggcggtgaggcggccgctaggcccggaggcggcgccgctgctgtcgcacggagctgcagtggcggcccaggcgctcgtcctcctgctcatcttcctgctgtctagccttggcaactgcgcggtgatgggggtgattgtgaagcaccggcagctccgcaccgtcaccaacgccttcatcctgtcgctgtccctatcggatctgctcacggcgctgctctgcctgcccgccgccttcctggacctcttcactccgcccgggggttcggcgcctgccgccgccgcggggccctggcgcggcttctgcgccgccagccgcttcttcagctcgtgcttcggcatcgtgtccacgctcagcgtggcgctcatctcgttggaccgttactgcgctatcgtgcggccgccgcgggagaagatcggccgccgccgcgcgctgcagctgctggcgggcgcctggctgacggccctgggcttctccttgccctgggagctgctcggggcgccccgggaactcgcggcggcgcagagcttccacggctgcctctaccggacctccccggaccccgcgcagctgggcgcggccttcagcgtggggctggtggtggcctgctacctgctgcccttcctgctcatgtgcttctgccactaccacatctgcaagacggtgcgcctgtcggacgtgcgcgtgcggccggtgaacacctacgcgcgcgtgctgcgcttcttcagcgaggtgcgcacggccaccaccgtcctcatcatgatcgtcttcgtcatctgctgctgggggccctactgcttcctggtgctgctggccgccgcccggcaggcccagaccatgcaggccccctcgctcctcagcgtggtggccgtctggctgacctgggccaatggggccatcaaccctgtcatctacgccatccgcaatcccaacatttcgatgctcctagggcgcaaccgcgaggagggctaccggactaggaatgtggacgctttcctgcccagccagggcccgggtctgcaagccagaagccgcagtcgccttcgaaaccgctatgccaaccggctgggggcctgcaacaggatgtcctcttccaacccggccagcggagtggcaggggacgtggccatgtgggcccgcaaaaatccagttgtacttttctgccgagagggaccaccagagccggtgacggcagtgaccaaacagcctaaatccgaagctggggataccagcctctaagacggttggaatggccagcttatgaaggcaaatttccactcgcattatttaatgatggaagattctgggggagagttgtggatttcataaagccaaacatttaaagctagagacgggggaggcttaccactttccccaaacaacataaaagacaatgtcccttcttcaaaagtgccaaaaggaatgtaaaatgcaaaaattaaaacaatcttaaaccacataaccaagcattgtgaactgtaagtgccaaaaatgacaaaaataacattcactataactgaaaagctcatattataggaccacactgtgaaacaaacaaaacattgaatgcaaccagtattgttcaactacacagaatttcaggaatgaatggagaccttcagagctgcttgaaagcccctctaaatcgctaccatccaacaaaactttagcttctagagcttgcacctctgacatgctttgggtgcttagattgcaagtggaaaagtcttatccttacacacattggtgcacctcctcaccccaccccctaataacctttgtggaaaatttttaattcataacccatttaaaatcattttaggattttgaaaagctggttattattagataaaattcaaccatctgaaggacaaatagaagtatgaacataaagaaatgtgtcttttaaatgttttccaagattatatgtaaaaattaacattccttccacccgcgtcatacctccaaaatgatcttccttggaaaactttgaagttttatccttactctaacctgttacttttatttctgataaattttggaatgctgctctcagaatgctttcacatttaaaaaaatattttcattgtagaaaatttttgtcttttgaggtaaatttgatttttggatatagccaaaaatgtaatttgaagtcaagttgattgaataaggtgagtgatgccactttatttaaatttttattattttttaaaatgagacctctataaaacaacaaggttgggtttcctacgtggcttttagctaactgaaaacgattccaaagagaaattctaaaactattttgagaagcagcctcttggaattagcgtagacttttccaaatagatcataccctcctacatttagaaatttggtatattttgtattttttaaaatagctgatggttgctttatagctatgacttgtcgaagataatgtatttattaaagggagaataggtgtgggactatatgtaacggtattaaaacacaggcataaagttggagaagaacttcaagcaaactgaaaatatctttagaaatatgcaaatcaaagatgctttttaaatttctatcttagcagaaaagatggttttacaataattcaaaagcgtatgtgaactttctaatgttaaatacgactatacacagaatcatttactcagaatttttttaaatattatttttccctttcttttcctccatcctgccccttttcttcagtatttcatagccttaattgaacaagttatttacagtagatatgaaaagacattagctgtcgtatgaagatttcaatgtgaaatagccagcattttcttcctgtaaagtatttaaatatgtttttaagtatttctttgtttgacaggtgggtacatgtcattattttgtaatcaaaggtggaaatatatgagtcatgtcagagctaaagatgttttaattttttctgcttctcagggtatcatcacaaatcagaagtttgtaaattgtatatattttgctacactcaatgtagtacaaagtagatgagataatccctcccctctagcccttattttataaagcatatacagacttcatgcagctggactaacaaaaacaggtgtctgcggtatttgcctgttaaaggcaaaaaattgtgtattttttggcaccgagtcacttttgggatttagagagaaatgataaagtcttcaattataaaagacatcatagaatagaagtacagttgtgaataaagggcagagggttagagatcttagagtaaggaggtgagcgtgttgcaaaatagtgtgttgcctgagaagaagaattgaaggaaggcattgaaaaataaatgtgatatagaataaacctacctggtgagtgaagggaaaatctgagagattggaagtgacaaggtgatggcatgaaggactttaaggaagaaaaggaattccagccctaccttttcggtggcaggaagttttaggaaaggcatggcttgtgaaagaggccattctgttagtggctccgagagtcatggtaggcaagaattggaggggaaaaagagaaaattgttcataaattactgaacaatttacaatgctctaaattgtttgtttttaatccaaggctatccaactatttagtggtagaactaggatttgaactgcagtctgtttggcctcagaactccatgtttgtttctctctatccccacagaagtctacaggtaaggaaatcaatcatgatcaattatggtactgtcatcattatcatcatcgtgatcatcatctaccatttttgtttcctactttatataagggcaacttcctgggagctaaggctactaaaaggtagaagccacagtactcatctgcagagggcttacagcctcagcaaggaccttgtggctttgtaacaacaatcagccataacaagtttacttgtggaaaagaaaaggtgtagcactttcagaagaggctatcaaagaaaagagatgaacttggaagcaagagatacgcaggtataagtcagccacccatttgacccagtgtaaatacttagacaatcaatacctcaaaaggtgaagaaagaatgattctcaaaataatctaagacttcgacctttcgttgtgcttactatgagtatgcaattatagtgacttcatgggaaaacgagaaagaaaagctatgaaatattggaatggattaaatattgagtactatgtaa

SEQ ID NO: 8770 - DNA, 4082 bp, Homo sapiens
  ENST00000377893
ccgccgccagcatgccccggcccgcgggccgctccgccgccagccacccccgcggccctcggcggcctgcgctcggcccgggggcgcgggaaccgcagccggagccggaggcgggagcagcgagccggagccccgggcgctcgaatgcaggatgctcgtggtccccagcatccttgagccaccaggagtgagggctgctgctccctgagacctggctccaaggaggatgccacagccgcctgccagctccggtctgcaccatgagtgatgagcggcggctgcctggcagtgcagtgggctggctggtatgtgggggcctctccctgctggccaatgcctggggcatcctcagcgttggcgccaagcagaagaagtggaagcccttggagttcctgctgtgtacactcgcggccacccacatgctaaatgtggccgtgcccatcgccacctactccgtggtgcagctgcggcggcagcgccccgacttcgagtggaatgagggtctctgcaaggtcttcgtgtccaccttctacaccctcaccctggccacctgtttctctgtcacctccctctcctaccaccgcatgtggatggtctgctggcctgtcaactaccggctgagcaatgccaagaagcaggcggtgcacacagtcatgggtatctggatggtgtccttcatcctgtcggccctgcctgccgttggctggcacgacaccagcgagcgcttctacacccatggctgccgcttcatcgtggctgagatcggcctgggctttggcgtctgcttcctgctgctggtgggcggcagcgtggccatgggcgtgatctgcacagccatcgccctcttccagacgctggccgtgcaggtggggcgccaggccgaccgccgcgccttcaccgtgcccaccatcgtggtggaggacgcgcagggcaagcggcgctcctccatcgatggctcggagcccgccaaaacctctctgcagaccacgggcctcgtgaccaccatagtcttcatctacgactgcctcatgggcttccctgtgctggtggtgagcttcagcagcctgcgggccgacgcctcagcgccctggatggcactctgcgtgctgtggtgctccgtggcccaggccctgctgctgcctgtgttcctctgggcctgcgaccgctaccgggctgacctcaaagctgtccgggagaagtgcatggccctcatggccaacgacgaggagtcagacgatgagaccagcctggaaggtggcatctccccggacctggtgttggagcgctccctggactatggctatggaggtgattttgtggccctagataggatggccaagtatgagatctccgccctggaggggggcctgccccagctctacccactgcggcccttgcaggaggacaagatgcaatacctgcaggtcccgcccacgcggcgcttctcccacgacgatgcggacgtgtgggccgccgtcccgctgcccgccttcctgccgcgctggggctccggcgaggacctggccgccctggcgcacctggtgctgcctgccgggcccgagcggcgccgcgccagcctcctggccttcgcggaggacgcaccaccgtcccgcgcgcgccgccgctcggccgagagcctgctgtcgctgcggccctcggccctggatagcggcccgcggggagcccgcgactcgccccccggcagcccgcgccgccgccccgggcccggcccccgctccgcctcggcctcgctgctgcccgacgccttcgccctgaccgccttcgagtgcgagccacaggccctgcgccgcccgcccgggcccttccccgctgcgcccgccgcccccgacggcgcagatcccggagaggccccgacgcccccaagcagcgcccagcggagcccagggccacgcccctctgcgcactcgcacgccggctctctgcgccccggcctgagcgcgtcgtggggcgagcccggggggctgcgcgcggcgggcggcggcggcagcaccagcagcttcctgagttccccctccgagtcctcgggctacgccacgctgcactcggactcgctgggctccgcgtcctaggaccgccggcgcctccccacggacgccaggcaggccaggccgctctccggggccgcagcaccaaagacgcccgcctccgccccgcgcgcagacatgcgccacccctcccaggggtgagggggcgttggcctcagcgtttgtcttccggctcctcccagctggccttgtcccaggggcgacggctgccccggacgactgcgctgggcaccgcatgtcccgggccgagtgaggtcgggcctggggagctgagtgacatcccaagcttgggcttgggtagtgagtgacatgtgcacacgtccagctgcgccatcaccagccctgcgcaacaggacgtcgggagcagggaacctgagacagggccactgcgggatcggacaaagccccgctttggagaggctgagctggagccattggcctccccaggggctttccacccacactgcaccataaccgccacacccttcggggggggggagggtacagagggtctctaagcacaggggtgttcagagcccgaacaagctttgatcaggtttccctgcttccgacctgtcctgcctcagtttccccatctgtgatgagcaggtgaccacgttaactctcagggctgtttgaagtctcttggttgtaggccctcgccactgagtggcccaggtgtgagaggtagtctagagccctctgcggcctttgtggaggtccgttttcagcatgtggcctggtgtggctccctaggcctgaggcctcccactctcagtgccccctgcccccttgggaacccacactccaccccagctaagcacaacactgtggaccaccaccaatggcacctgagccaccttgaccaccattagtgtccccaccctcattactctgccgtcgttgcctgtccccaccacatcatctccctccatggctcccaccatgacgctggcaggtgcaagcggagagcacgagggcagcagggcctggccttccgtgtccctgcgtcatccccagcctcactccccacccgtgcaggcctggccaggaagggatcctggcaggggcttccaggttctcagctcaaggcctggtcccgggcaggcgtccaacccctgggagcaatgtatttctttgccttccatcctgggcagaccccttacaggcctgggcattgccatgggccctgggtcttcccaggctaaggagaaccaggaacagctataaccttgagctagtgaaatagggtagatgagaaggctgtctcctccagacccctacccctacacagtggccccacaatatgaagacctggggtaattccaaggtgagcatagagcctgcctgtgcccagttccttctggccctcaggtggccaagcccatctcttcatccttcagatagggtcccactcccagaagaagctgctggggtgggggtgggaggctgcctaagcctgtctgtgcttcagaggcccctccagtccctggctgtggggtaactgggggtatgagctgtggccacaggtgagcaaggcagggaactgcaatccagccctggccgcgggaggggccatctctggccaatgctgctgtgccttcaaggactgacaagttacgtaggggcagaggtcgccagctagccagtgtctcctccatctggggggcgtctgtccacttgtcaccttaggttttcactcatttgtcaccttggggttttgctctgtgtgtttcatatccaacggcaatacttgcagggggacagagtcctctaaatactccaatcctgcggtttttacaaacataaagggggagaccccaagtggaggaccctgggcctggagctccctcccaaactttgtccagcatccagcctgttccctgggctcactggggagggagttgtcttcatagcacacccagagccagggatccctttgtagttttttgacaacggagcatttctcttctgtacaggacccaataaaaacttccttatgatttgcacctggca

SEQ ID NO: 8771 - DNA, 2676 bp, Homo sapiens
  ENST00000367838
gtaggtgcgtgcccgggactctgccgatgcgggccgcgccccctggggccaagagactccacgtcccgctcagggcaaagggtgtggggagaagcggtcacgcccctcggctggaatccgtgaggaccaggtctttttcagtgtgctcaatatggtcaccaagcctggaaacatagagtctcaccctgttgcttaggcagatggcgcgatctcggctcctgggttcaagcaattctcctgcctcagcctcctgaatagccgggattacagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaa

SEQ ID NO: 8772 - DNA, 2512 bp, Homo sapiens
  ENST00000478868
tgctcttgggagcctttgaaaaaccacctctgacttgacctgggtttcctgttccccatgagtgctccagggctgcgcctaagcctgtgtcatggaactcaggggtgagccttggggttggcaccgggaccaggccatgacctctcttagtcatggagaattttccttggaaaattccttatctggcaacccagagggccccgcaccacacggagtcatatatgaagcactgatcacactgtgccctctaggcctgagtccctcatgtgatttaaggaaagtctctgttactccccagtctgcttccctgttctcagacaactaaagggatccagaggcactgcaacattcattcattcattcattcattcagcagttatttgccacgttcctgccttggccggaccctgtgccagatgctgggggcacagtggtgaactgccattgttgtggaggcttcagttcataaaagattgaactgtaaagtatataaagattgtaaagtatacaattctcattgaattgtatactttaaatgagtcagttacatggcatgtgaattacatctctataaaactggttttgaaagatgatgaatgtgtcgagagctgtgaaaggggaagccctagtggagtgggagcccgtgggctgctataggtaggggagttagagagactgctctgagcatgcgatgtcgaaagctgaagcatacgtggaaggtgccccggcgcaaggagtgaggggacagcactgtaggcagaagaaagagcatgggcttcggggcacacagatctggtgtgagtctcagccctgccctttgttcgctgtgtccttatcaggaatgatggccctcaatttagcccctgctgtgtgcaagcactatgctagatgtttacatgtctcaactcaaaatccccacaactccgtgaggtagactgaatgatgaccccaggtttacagacgtggaaagatactgaggcattaaataacctgccagtgatcctaggtctgtccgacccaagcctgtgtgtttaaccaccatattctacctcccaaaggactgtttcttctctatgtcgggtaatcacacctctgcgaggtgctctgaaacagcatctaaagagctccaggtttctctttcttccttattttctgagcttcaaggcctttatggattgaaagctggaagctaagaacggggctggatctgacactggtcctagtgttggggaagggcactgttgagtgatgggtcccatctcagctcttccttccctcccttccctctgccccattccctctgcctgctctgcccacctatctctagtaggacttccctgaccttctccctttatttccctgctttttaggggaaaatttgtcaattattttttgatccccaaagaactctacattttggagctttacatgtttatttagtacaacatattttaactgtggtgatagaaattcagactgtaggaagaatcactcagaatataaagttccttttagtaggaccctctcctctactcggcccttctccccacttcccttccatgctgggccggcagatgccatgcttctggggtctggtcattgaggcagataaccccctacttcagataacttggctgcattttttgtgtggctgacgcagccccaccggctgtctgcaaactccctgaaacaggatgacaggcgggtgtttcttgggcacgtgctgcggcgcagtcagctccacttgatgatgggtttggatgaacgggagaagaggggtggaaggggtgttgagaggggagaagaggccaggaggactttagattgtagttacatatgcacaatctgcccgttgttttagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaacc

SEQ ID NO: 8773 - DNA, 1983 bp, Homo sapiens
  ENST00000367836
ggtgcgtgcccgggactctgccgatgcgggccgcgccccctggggccaagagactccacgtcccgctcagggcaaagggtgtggggagaagcggtcacgcccctcggctggaatccgtgaggaccaggtgagcagccttctcccagccgggactcagggcgctgtctccccgagcctgggcgggcggcgggtggcgcgcccagaagtggcccggcgccgccggatgggcggctctgcccctcagatctgcgggagggagattcggctggttcttggaaaggggagaactcgaccagccctcggcgccttctgggccaagcttaacccccgtgcaacctttggacaaaggcatatgggatgagaacgtctgttggcctggtgcactgtgcgtcctctgagaggtgaaggagcactgtgtggtcagagggctgcgagctctctgtttgggttccgaggaagacagaatgggctgaactggaactgacctaaatgtcagcaagaggagctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaa

SEQ ID NO: 8774 - DNA, 2400 bp, Homo sapiens
  ENST00000367835
gttttgtgatgactgctccctggccttttggttccgagggagtgcagggcagcagtgtgaagacctgtttacgtccactccccactccccggggctggcttcgggacgaattcactgtggtattaacagagcccgggacagagcctggcagaaggcagatggatgctcgtgcccgtcggctggatgaatgaaaggtgagcagcaaaggcgataccaggatcgtccacggcgggactggaggaggagaatgggactgtgcggagcctgcgggaagaatctgaaagtgtctgtgtgatggagagagacatggaaaaggcgacgtcccagcggctggaactggggcggaggaacgggaacagggaaggcctgagttaggcaccacaaaggttttcaggagaaaagtggggcgagccgagaggagtctcaccctgttgcttaggcagatggcgcgatctcggctcctgggttcaagcaattctcctgcctcagcctcctgaatagccgggattacagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagc

SEQ ID NO: 8775 - DNA, 1381 bp, Homo sapiens
  ENST00000493800
gccttatctttccagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcaggtaacctgcgtgctttataagcctctcacctgtcgcgttttccctgtgttgcgtttcccccgtgtcgcgtttcccctgtgcaggctcaagagctggcggaggggcatttcccacggtg

SEQ ID NO: 8776 - DNA, 313 bp, Homo sapiens
  ENST00000485232
gcctggtgcactgtgcgtcctctgagaggtgaaggagcactgtgtggtcagagggctgcgagctctctgtttgggttccgaggaagacagaatgggctgaactggaactgacctaaatgtcagcaagaggaggtctttttcagtgtgctcaatatggtcaccaagcctggaaacatagacagagcttcattcttgttgctcaggctggagtacaatggcacgatctcggctcactgcagctgccacctcctgggttcaagcgattctcctgcctcagcctctcaagtagaaatttttttttatgtgtatatat

SEQ ID NO: 8777 - DNA, 7388 bp, Homo sapiens
  ENST00000546300
gactgctccctggccttttggttccgagggagtgcagggcagcagtgtgaagacctgtttacgtccactccccactccccggggctggcttcgggacgaattcactgtggtattaacagagcccgggacagagcctggcagaaggcagatggatgctcgtgcccgtcggctggatgaatgaaagctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaagacgtaccactgttttaccggactgaatgggactgtagtgccaagcacagccaggaaatagagaaactgttattatggaagggaatttgttcacatgggaaagcctcattaaatagattctatgtgtgatgtttgagtgaccaatgaaaatagctggcctcagttctgcatggcacactcccaagagcaacagttactattatcacaagcctggtataaataagatagaagcagccctggacccacagccagcaacctgggttattggcccagctctgtctttgtgtgcacatgtcatttggacatcttgtcacctttctaggtcctctgtaaagtgggaaaacagagtggagttggattgaatggtctccaagatcatttccagctctgacctttggtgttctcaggatttgtaaagcagagataggtaaaacacaaaagcagacccacggaccgacctttgtataactttggagtgtggttgctcatgcacatgtgaagtgcaggcagatcaaggttctgtggctttgtctgccctgtccattagagcacaatctggatagaatgccagccaccaagatgcatgaggggcagggtcaccatctcagaaggggaagcacaggaatgtgattgggatggttaaacctctcttctcctccctttgtgctggaacagcagttgaagtttggtcctggagtaattgctgtgatgacttgggaagccactgatctcctcttgcgtctgcccttggcctgcatcatgactaaataagttcaggacttctctgctttggttggcagaaggtagattccaaggagatcttgctggttgctgagaggcagctgttctagaaagtgaattacccttgtggttttttctttggggcccagctagctcctggtgaggttgtgtttttgtgttgtgtggcagaaaccaatggttagctggtcccctggtctgcagtttgtaaaagacctttcatgaggcctggagtcttgctacctgtggtgattgaactcaactattctgggtcacctggatgccaggcgctggcctagcttctggatgggagtgggaaggagcagagggcaggttcacctgtgcaggtcagacactctgcttccatcactggatggcattcctacgtctgcgtgtggttcacgttttctatatatattccctgtatatatttttttctagcacttgtctactttctgaagggaccatattcctgatcaactagtgtgcacagaggtggaacagggcagagagacctttatctctaggatgggttgctggttaggtgtaggcattcttgagtgcagcagcttggctttgaaacgcaagggttggagaatgttcccctgactgtactagactgggctctagggaaagaatcctgagacagccccccactcccccactgaccccacactagctgggctattatagaatttaatctaaatctagaaatactgcatttcacaaaatgattcactgtgtttccctttttttactgaggtccaattcatttagtcgtctaccagacactgcacatccagtgtatgcgaagcaccaggctaggctctgtaggcaataccactaaagtgtgcactctgatttagggagcaggacctgtggataccgattctaataactagcaaagtcaagtcgtggttatagaaagaagtgtggcttcagagggaggtgggtatttccaaatatggagttagggatggctccatgaggtaagtgacagtttgagctaagtcttgaaggatgcttggcagctagaaccatattttccatattcaggaattcaaatttgcctttattcagctagagagaaagagagaagggggtgtgggggagaaggaaaagagaattttcacacattttgaagttcctgagagcatttctgaggatatctgccgttagtgcagaaggtcgaaaccccaagtgcccccactaaacccaggctctttagctgtaaactgccatgcagtggcaggcctgcagccttcctgatgggaccacatggacagtggcacatgggacatttggctactcgttagcttaaacaactcagtcctgtgtcttctggttttgacaagaccacatttaggactgctgcccacctctgcctctttcattgagatttccgccttattgggtccctgtgctatgccacagataccaggtttggggttgttttgacccagaaggcattgggagtcccacattacagagcacacacacagctcaacacagccatttccctggccagaggcaccaagactgaagttcaggcccttagacactaggtggcagcggtgtggctgtgcagagccaaggatgaacctgagagcttgtttgcctctggctgggcactcttgttttgaattcctttgcccttatcgtgtagtccacggccttggtgaccaaggaccacctggctagcctgcttacatgcatgaccccatccaggttcacaggtattgccactgagtgatcttaggtagatcactgctcctggagaagcagagttgaggagtgtaagacaagggccatctagtgccaatgttccttgattcttatttgaggagctactatgtggtctttctgtaaacaagtgaacaaccaatgagactaaatatttgcaatagataggctaaggaatttgggttgagacaggagacggaggaaaaatgctttgatacaatgacagatggttagtctcttcagatttccctgaatattttccatcccgacaatatgcctcttagatacttgcagattagacatgtctctggatggaccacaagatacattcacaacatgtgttcagccttgagccctggctgtgtcctgtctggaaggaactgaggatgatgtggctataaagaggaggcagtgagctggcatgtgactgccttctgtgggcctgacctgtttgacatttgagggcctatgatgtgctaggtgctgtgttaggtacttccaaatgctttatctcattttaccccagtgcaagtgtgatatagtgaggatggtgaagacgtgggtatggttaagtcatgagttcagatcccgtgcttccaattacatgggtgttttcaaacaagtcactacttatgagtttcctcatctgtgaagggaagtttagtcatctgtttcaatgtggagacacacaggattgagggagtcctccgtcacagggtgactgtctggattctatgaggaaatacttggaaagcatgcagcacaatgcctggggtgcagctgaagctgagccactggtgtttcttcacagtatctctgtggggagggtgtattattcctttttatagggatctctataatgaagtgagaatcttgaaaatataagtgttatcctagatgggaggtgttaaaggtttttgccttgggaattttgtcatatttgttgcacagcaaggaaggactttcagaaaagcagggatgtggtgaggaagagcaggcaatagagagcagggaggaaaggctaagtagcatctggaacttgagaagtctaagggagccaaaatgagattttctattaaaaatgtctatcctcagccgggcgtggtagctcacgcctgtaatcccagcactttggggggtcgagatgggcagatcacctgaggtcaggagttcgagaccagcctgaccaatatggagaaaccccgtctctactaaaaatacaaaattagttgcgcgtggtggtgggcgcctgtaatcccagctactcaggagcctgaggcaggagaatcacttaaacccaggaggcggaggttgcagtgagccgagatcgcgccattgcactccagcctgggcaacaagagcgaaaccccgcctaaaaaaagaaaaaaaagaaaaagtctatcctctatgctactggcctgtttgtacaaagataaaatcattctaatttgtccggaatgactatcaaagatgatcaaatccccagggcctggtgtaacgttccaaatcatagcacaaatacagcttgaccttccttacagtccagaaaggacattctccctgagaaatgcccttggttgctgaggacagctctgtcctgtagtgacagagtgactgcctggctgtggctcttgggttcacagaatccctaatcctccaagcccctaagaggcagggcagggatgctacccacaatatatgcagaaccccagatggagcctgtgggagagagaggaaattaccgtcttcactgtaggcaaaggagaatggctgtgattagccatatatgcctataagaaggagcagagccatactgtccttgtgggttgggagaggggacacagaatccagggcaattgtctgaggtctcaaagtaagttaagccagagtcaaagccaaactccaagtcttggccaaggggatgagaaaagcaaggagctagtcttataggtcaaggaagatgaggtatagttaagagtcatcagtatcacagaacaggccagcagggctttattaggtatgtagaactattataaaccaaggatcttgggagatattaatatctgctggccagacctaaaaaaaactgaaggcccaaggaaagtgactggactcactggaaagtatctaacaaatactttggattccaaagtatttccaataccttgaagattcctttgaaaacatcaaagcacaaactcaaatctgcacaagattacaaaagcacaattttggtgttatttttagaatgcaatacacaaagctatgttcatttctctcagcaagcattttcctgggtagtagtaatagcttaggaatcaaatgccacttttgtttttccttttttcactagtttgaaataccacaaatcacaggtgagtcagtcctcccagaggaaaagacagtcctagggagaatcacaggcctggcagacaagaccacactgagagcagtagaaggaacctgcatgcttaagggacagaggactgtgttgtgttctcataatagaccgctggatgaagaagtggttaaaaaccaaccctcgaaaaacaaaaatccctggctaatcctgaaatatatttaacttgaagtctttggatgatttttttaaggttaaaaaaaagtttaggattattataaatcaatatttataaataagcaacaatgtatttggaatttttgtttacctgattaaatatgtttttggtatgtgt

SEQ ID NO: 8778 - DNA, 7806 bp, Homo sapiens
  ENST00000271357
gactgctccctggccttttggttccgagggagtgcagggcagcagtgtgaagacctgtttacgtccactccccactccccggggctggcttcgggacgaattcactgtggtattaacagagcccgggacagagcctggcagaaggcagatggatgctcgtgcccgtcggctggatgaatgaaagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaagacgtaccactgttttaccggactgaatgggactgtagtgccaagcacagccaggaaatagagaaactgttattatggaagggaatttgttcacatgggaaagcctcattaaatagattctatgtgtgatgtttgagtgaccaatgaaaatagctggcctcagttctgcatggcacactcccaagagcaacagttactattatcacaagcctggtataaataagatagaagcagccctggacccacagccagcaacctgggttattggcccagctctgtctttgtgtgcacatgtcatttggacatcttgtcacctttctaggtcctctgtaaagtgggaaaacagagtggagttggattgaatggtctccaagatcatttccagctctgacctttggtgttctcaggatttgtaaagcagagataggtaaaacacaaaagcagacccacggaccgacctttgtataactttggagtgtggttgctcatgcacatgtgaagtgcaggcagatcaaggttctgtggctttgtctgccctgtccattagagcacaatctggatagaatgccagccaccaagatgcatgaggggcagggtcaccatctcagaaggggaagcacaggaatgtgattgggatggttaaacctctcttctcctccctttgtgctggaacagcagttgaagtttggtcctggagtaattgctgtgatgacttgggaagccactgatctcctcttgcgtctgcccttggcctgcatcatgactaaataagttcaggacttctctgctttggttggcagaaggtagattccaaggagatcttgctggttgctgagaggcagctgttctagaaagtgaattacccttgtggttttttctttggggcccagctagctcctggtgaggttgtgtttttgtgttgtgtggcagaaaccaatggttagctggtcccctggtctgcagtttgtaaaagacctttcatgaggcctggagtcttgctacctgtggtgattgaactcaactattctgggtcacctggatgccaggcgctggcctagcttctggatgggagtgggaaggagcagagggcaggttcacctgtgcaggtcagacactctgcttccatcactggatggcattcctacgtctgcgtgtggttcacgttttctatatatattccctgtatatatttttttctagcacttgtctactttctgaagggaccatattcctgatcaactagtgtgcacagaggtggaacagggcagagagacctttatctctaggatgggttgctggttaggtgtaggcattcttgagtgcagcagcttggctttgaaacgcaagggttggagaatgttcccctgactgtactagactgggctctagggaaagaatcctgagacagccccccactcccccactgaccccacactagctgggctattatagaatttaatctaaatctagaaatactgcatttcacaaaatgattcactgtgtttccctttttttactgaggtccaattcatttagtcgtctaccagacactgcacatccagtgtatgcgaagcaccaggctaggctctgtaggcaataccactaaagtgtgcactctgatttagggagcaggacctgtggataccgattctaataactagcaaagtcaagtcgtggttatagaaagaagtgtggcttcagagggaggtgggtatttccaaatatggagttagggatggctccatgaggtaagtgacagtttgagctaagtcttgaaggatgcttggcagctagaaccatattttccatattcaggaattcaaatttgcctttattcagctagagagaaagagagaagggggtgtgggggagaaggaaaagagaattttcacacattttgaagttcctgagagcatttctgaggatatctgccgttagtgcagaaggtcgaaaccccaagtgcccccactaaacccaggctctttagctgtaaactgccatgcagtggcaggcctgcagccttcctgatgggaccacatggacagtggcacatgggacatttggctactcgttagcttaaacaactcagtcctgtgtcttctggttttgacaagaccacatttaggactgctgcccacctctgcctctttcattgagatttccgccttattgggtccctgtgctatgccacagataccaggtttggggttgttttgacccagaaggcattgggagtcccacattacagagcacacacacagctcaacacagccatttccctggccagaggcaccaagactgaagttcaggcccttagacactaggtggcagcggtgtggctgtgcagagccaaggatgaacctgagagcttgtttgcctctggctgggcactcttgttttgaattcctttgcccttatcgtgtagtccacggccttggtgaccaaggaccacctggctagcctgcttacatgcatgaccccatccaggttcacaggtattgccactgagtgatcttaggtagatcactgctcctggagaagcagagttgaggagtgtaagacaagggccatctagtgccaatgttccttgattcttatttgaggagctactatgtggtctttctgtaaacaagtgaacaaccaatgagactaaatatttgcaatagataggctaaggaatttgggttgagacaggagacggaggaaaaatgctttgatacaatgacagatggttagtctcttcagatttccctgaatattttccatcccgacaatatgcctcttagatacttgcagattagacatgtctctggatggaccacaagatacattcacaacatgtgttcagccttgagccctggctgtgtcctgtctggaaggaactgaggatgatgtggctataaagaggaggcagtgagctggcatgtgactgccttctgtgggcctgacctgtttgacatttgagggcctatgatgtgctaggtgctgtgttaggtacttccaaatgctttatctcattttaccccagtgcaagtgtgatatagtgaggatggtgaagacgtgggtatggttaagtcatgagttcagatcccgtgcttccaattacatgggtgttttcaaacaagtcactacttatgagtttcctcatctgtgaagggaagtttagtcatctgtttcaatgtggagacacacaggattgagggagtcctccgtcacagggtgactgtctggattctatgaggaaatacttggaaagcatgcagcacaatgcctggggtgcagctgaagctgagccactggtgtttcttcacagtatctctgtggggagggtgtattattcctttttatagggatctctataatgaagtgagaatcttgaaaatataagtgttatcctagatgggaggtgttaaaggtttttgccttgggaattttgtcatatttgttgcacagcaaggaaggactttcagaaaagcagggatgtggtgaggaagagcaggcaatagagagcagggaggaaaggctaagtagcatctggaacttgagaagtctaagggagccaaaatgagattttctattaaaaatgtctatcctcagccgggcgtggtagctcacgcctgtaatcccagcactttggggggtcgagatgggcagatcacctgaggtcaggagttcgagaccagcctgaccaatatggagaaaccccgtctctactaaaaatacaaaattagttgcgcgtggtggtgggcgcctgtaatcccagctactcaggagcctgaggcaggagaatcacttaaacccaggaggcggaggttgcagtgagccgagatcgcgccattgcactccagcctgggcaacaagagcgaaaccccgcctaaaaaaagaaaaaaaagaaaaagtctatcctctatgctactggcctgtttgtacaaagataaaatcattctaatttgtccggaatgactatcaaagatgatcaaatccccagggcctggtgtaacgttccaaatcatagcacaaatacagcttgaccttccttacagtccagaaaggacattctccctgagaaatgcccttggttgctgaggacagctctgtcctgtagtgacagagtgactgcctggctgtggctcttgggttcacagaatccctaatcctccaagcccctaagaggcagggcagggatgctacccacaatatatgcagaaccccagatggagcctgtgggagagagaggaaattaccgtcttcactgtaggcaaaggagaatggctgtgattagccatatatgcctataagaaggagcagagccatactgtccttgtgggttgggagaggggacacagaatccagggcaattgtctgaggtctcaaagtaagttaagccagagtcaaagccaaactccaagtcttggccaaggggatgagaaaagcaaggagctagtcttataggtcaaggaagatgaggtatagttaagagtcatcagtatcacagaacaggccagcagggctttattaggtatgtagaactattataaaccaaggatcttgggagatattaatatctgctggccagacctaaaaaaaactgaaggcccaaggaaagtgactggactcactggaaagtatctaacaaatactttggattccaaagtatttccaataccttgaagattcctttgaaaacatcaaagcacaaactcaaatctgcacaagattacaaaagcacaattttggtgttatttttagaatgcaatacacaaagctatgttcatttctctcagcaagcattttcctgggtagtagtaatagcttaggaatcaaatgccacttttgtttttccttttttcactagtttgaaataccacaaatcacaggtgagtcagtcctcccagaggaaaagacagtcctagggagaatcacaggcctggcagacaagaccacactgagagcagtagaaggaacctgcatgcttaagggacagaggactgtgttgtgttctcataatagaccgctggatgaagaagtggttaaaaaccaaccctcgaaaaacaaaaatccctggctaatcctgaaatatatttaacttgaagtctttggatgatttttttaaggttaaaaaaaagtttaggattattataaatcaatatttataaataagcaacaatgtatttggaatttttgtttacctgattaaatatgtttttggtatgtgt

SEQ ID NO: 8779 - DNA, 7655 bp, Homo sapiens
  ENST00000539777
cccgggcggagagggcggtccggatggagccaggctaaactcattgtgcgaggctgagggctcagggcgcgggccgggaagggtccccgcccccacggcgctccctttctccccgcgcccctctcggaggtcagggctgtcctccgcccgcactgcgccttgctttggagagctggagctctttgtgggaagatgttgggggcgcgcccctcccctgcggcctggggcttctgagaggcccaccccattctgctgggtgcagcccgccccgtttctccggcgccgcccgaagcccctaaacagtccgctggatgggagggcgtaggtgcgtgcccgggactctgccgatgcgggccgcgccccctggggccaagagactccacgtcccgctcagggcaaagggtgtggggagaagcggtcacgcccctcggctggaatccgtgaggaccagctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaagacgtaccactgttttaccggactgaatgggactgtagtgccaagcacagccaggaaatagagaaactgttattatggaagggaatttgttcacatgggaaagcctcattaaatagattctatgtgtgatgtttgagtgaccaatgaaaatagctggcctcagttctgcatggcacactcccaagagcaacagttactattatcacaagcctggtataaataagatagaagcagccctggacccacagccagcaacctgggttattggcccagctctgtctttgtgtgcacatgtcatttggacatcttgtcacctttctaggtcctctgtaaagtgggaaaacagagtggagttggattgaatggtctccaagatcatttccagctctgacctttggtgttctcaggatttgtaaagcagagataggtaaaacacaaaagcagacccacggaccgacctttgtataactttggagtgtggttgctcatgcacatgtgaagtgcaggcagatcaaggttctgtggctttgtctgccctgtccattagagcacaatctggatagaatgccagccaccaagatgcatgaggggcagggtcaccatctcagaaggggaagcacaggaatgtgattgggatggttaaacctctcttctcctccctttgtgctggaacagcagttgaagtttggtcctggagtaattgctgtgatgacttgggaagccactgatctcctcttgcgtctgcccttggcctgcatcatgactaaataagttcaggacttctctgctttggttggcagaaggtagattccaaggagatcttgctggttgctgagaggcagctgttctagaaagtgaattacccttgtggttttttctttggggcccagctagctcctggtgaggttgtgtttttgtgttgtgtggcagaaaccaatggttagctggtcccctggtctgcagtttgtaaaagacctttcatgaggcctggagtcttgctacctgtggtgattgaactcaactattctgggtcacctggatgccaggcgctggcctagcttctggatgggagtgggaaggagcagagggcaggttcacctgtgcaggtcagacactctgcttccatcactggatggcattcctacgtctgcgtgtggttcacgttttctatatatattccctgtatatatttttttctagcacttgtctactttctgaagggaccatattcctgatcaactagtgtgcacagaggtggaacagggcagagagacctttatctctaggatgggttgctggttaggtgtaggcattcttgagtgcagcagcttggctttgaaacgcaagggttggagaatgttcccctgactgtactagactgggctctagggaaagaatcctgagacagccccccactcccccactgaccccacactagctgggctattatagaatttaatctaaatctagaaatactgcatttcacaaaatgattcactgtgtttccctttttttactgaggtccaattcatttagtcgtctaccagacactgcacatccagtgtatgcgaagcaccaggctaggctctgtaggcaataccactaaagtgtgcactctgatttagggagcaggacctgtggataccgattctaataactagcaaagtcaagtcgtggttatagaaagaagtgtggcttcagagggaggtgggtatttccaaatatggagttagggatggctccatgaggtaagtgacagtttgagctaagtcttgaaggatgcttggcagctagaaccatattttccatattcaggaattcaaatttgcctttattcagctagagagaaagagagaagggggtgtgggggagaaggaaaagagaattttcacacattttgaagttcctgagagcatttctgaggatatctgccgttagtgcagaaggtcgaaaccccaagtgcccccactaaacccaggctctttagctgtaaactgccatgcagtggcaggcctgcagccttcctgatgggaccacatggacagtggcacatgggacatttggctactcgttagcttaaacaactcagtcctgtgtcttctggttttgacaagaccacatttaggactgctgcccacctctgcctctttcattgagatttccgccttattgggtccctgtgctatgccacagataccaggtttggggttgttttgacccagaaggcattgggagtcccacattacagagcacacacacagctcaacacagccatttccctggccagaggcaccaagactgaagttcaggcccttagacactaggtggcagcggtgtggctgtgcagagccaaggatgaacctgagagcttgtttgcctctggctgggcactcttgttttgaattcctttgcccttatcgtgtagtccacggccttggtgaccaaggaccacctggctagcctgcttacatgcatgaccccatccaggttcacaggtattgccactgagtgatcttaggtagatcactgctcctggagaagcagagttgaggagtgtaagacaagggccatctagtgccaatgttccttgattcttatttgaggagctactatgtggtctttctgtaaacaagtgaacaaccaatgagactaaatatttgcaatagataggctaaggaatttgggttgagacaggagacggaggaaaaatgctttgatacaatgacagatggttagtctcttcagatttccctgaatattttccatcccgacaatatgcctcttagatacttgcagattagacatgtctctggatggaccacaagatacattcacaacatgtgttcagccttgagccctggctgtgtcctgtctggaaggaactgaggatgatgtggctataaagaggaggcagtgagctggcatgtgactgccttctgtgggcctgacctgtttgacatttgagggcctatgatgtgctaggtgctgtgttaggtacttccaaatgctttatctcattttaccccagtgcaagtgtgatatagtgaggatggtgaagacgtgggtatggttaagtcatgagttcagatcccgtgcttccaattacatgggtgttttcaaacaagtcactacttatgagtttcctcatctgtgaagggaagtttagtcatctgtttcaatgtggagacacacaggattgagggagtcctccgtcacagggtgactgtctggattctatgaggaaatacttggaaagcatgcagcacaatgcctggggtgcagctgaagctgagccactggtgtttcttcacagtatctctgtggggagggtgtattattcctttttatagggatctctataatgaagtgagaatcttgaaaatataagtgttatcctagatgggaggtgttaaaggtttttgccttgggaattttgtcatatttgttgcacagcaaggaaggactttcagaaaagcagggatgtggtgaggaagagcaggcaatagagagcagggaggaaaggctaagtagcatctggaacttgagaagtctaagggagccaaaatgagattttctattaaaaatgtctatcctcagccgggcgtggtagctcacgcctgtaatcccagcactttggggggtcgagatgggcagatcacctgaggtcaggagttcgagaccagcctgaccaatatggagaaaccccgtctctactaaaaatacaaaattagttgcgcgtggtggtgggcgcctgtaatcccagctactcaggagcctgaggcaggagaatcacttaaacccaggaggcggaggttgcagtgagccgagatcgcgccattgcactccagcctgggcaacaagagcgaaaccccgcctaaaaaaagaaaaaaaagaaaaagtctatcctctatgctactggcctgtttgtacaaagataaaatcattctaatttgtccggaatgactatcaaagatgatcaaatccccagggcctggtgtaacgttccaaatcatagcacaaatacagcttgaccttccttacagtccagaaaggacattctccctgagaaatgcccttggttgctgaggacagctctgtcctgtagtgacagagtgactgcctggctgtggctcttgggttcacagaatccctaatcctccaagcccctaagaggcagggcagggatgctacccacaatatatgcagaaccccagatggagcctgtgggagagagaggaaattaccgtcttcactgtaggcaaaggagaatggctgtgattagccatatatgcctataagaaggagcagagccatactgtccttgtgggttgggagaggggacacagaatccagggcaattgtctgaggtctcaaagtaagttaagccagagtcaaagccaaactccaagtcttggccaaggggatgagaaaagcaaggagctagtcttataggtcaaggaagatgaggtatagttaagagtcatcagtatcacagaacaggccagcagggctttattaggtatgtagaactattataaaccaaggatcttgggagatattaatatctgctggccagacctaaaaaaaactgaaggcccaaggaaagtgactggactcactggaaagtatctaacaaatactttggattccaaagtatttccaataccttgaagattcctttgaaaacatcaaagcacaaactcaaatctgcacaagattacaaaagcacaattttggtgttatttttagaatgcaatacacaaagctatgttcatttctctcagcaagcattttcctgggtagtagtaatagcttaggaatcaaatgccacttttgtttttccttttttcactagtttgaaataccacaaatcacaggtgagtcagtcctcccagaggaaaagacagtcctagggagaatcacaggcctggcagacaagaccacactgagagcagtagaaggaacctgcatgcttaagggacagaggactgtgttgtgttctcataatagaccgctggatgaagaagtggttaaaaaccaaccctcgaaaaacaaaaatccctggctaatcctgaaatatatttaacttgaagtctttggatgatttttttaaggttaaaaaaaagtttaggattattataaatcaatatttataaataagcaacaatgtatttggaatttttgtttacctgattaaatatgtttttggtatgtgt

SEQ ID NO: 8780 - DNA, 8256 bp, Homo sapiens
  ENST00000537209
aggcaaagtggggagtgaggaagggaaaacaaacattctgagaaggaactgttccgtcccccgagctgacagcgcccgctctttgttttgtgatgactgctccctggccttttggttccgagggagtgcagggcagcagtgtgaagacctgtttacgtccactccccactccccggggctggcttcgggacgaattcactgtggtattaacagagcccgggacagagcctggcagaaggcagatggatgctcgtgcccgtcggctggatgaatgaaaggtgagcagcaaaggcgataccaggatcgtccacggcgggactggaggaggagaatgggactgtgcggagcctgcgggaagaatctgaaagtgtctgtgtgatggagagagacatggaaaaggcgacgtcccagcggctggaactggggcggaggaacgggaacagggaaggcctgagttaggcaccacaaaggttttcaggagaaaagtggggcgagccgagaggcctggtgcactgtgcgtcctctgagaggtgaaggagcactgtgtggtcagagggctgcgagctctctgtttgggttccgaggaagacagaatgggctgaactggaactgacctaaatgtcagcaagaggagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaagacgtaccactgttttaccggactgaatgggactgtagtgccaagcacagccaggaaatagagaaactgttattatggaagggaatttgttcacatgggaaagcctcattaaatagattctatgtgtgatgtttgagtgaccaatgaaaatagctggcctcagttctgcatggcacactcccaagagcaacagttactattatcacaagcctggtataaataagatagaagcagccctggacccacagccagcaacctgggttattggcccagctctgtctttgtgtgcacatgtcatttggacatcttgtcacctttctaggtcctctgtaaagtgggaaaacagagtggagttggattgaatggtctccaagatcatttccagctctgacctttggtgttctcaggatttgtaaagcagagataggtaaaacacaaaagcagacccacggaccgacctttgtataactttggagtgtggttgctcatgcacatgtgaagtgcaggcagatcaaggttctgtggctttgtctgccctgtccattagagcacaatctggatagaatgccagccaccaagatgcatgaggggcagggtcaccatctcagaaggggaagcacaggaatgtgattgggatggttaaacctctcttctcctccctttgtgctggaacagcagttgaagtttggtcctggagtaattgctgtgatgacttgggaagccactgatctcctcttgcgtctgcccttggcctgcatcatgactaaataagttcaggacttctctgctttggttggcagaaggtagattccaaggagatcttgctggttgctgagaggcagctgttctagaaagtgaattacccttgtggttttttctttggggcccagctagctcctggtgaggttgtgtttttgtgttgtgtggcagaaaccaatggttagctggtcccctggtctgcagtttgtaaaagacctttcatgaggcctggagtcttgctacctgtggtgattgaactcaactattctgggtcacctggatgccaggcgctggcctagcttctggatgggagtgggaaggagcagagggcaggttcacctgtgcaggtcagacactctgcttccatcactggatggcattcctacgtctgcgtgtggttcacgttttctatatatattccctgtatatatttttttctagcacttgtctactttctgaagggaccatattcctgatcaactagtgtgcacagaggtggaacagggcagagagacctttatctctaggatgggttgctggttaggtgtaggcattcttgagtgcagcagcttggctttgaaacgcaagggttggagaatgttcccctgactgtactagactgggctctagggaaagaatcctgagacagccccccactcccccactgaccccacactagctgggctattatagaatttaatctaaatctagaaatactgcatttcacaaaatgattcactgtgtttccctttttttactgaggtccaattcatttagtcgtctaccagacactgcacatccagtgtatgcgaagcaccaggctaggctctgtaggcaataccactaaagtgtgcactctgatttagggagcaggacctgtggataccgattctaataactagcaaagtcaagtcgtggttatagaaagaagtgtggcttcagagggaggtgggtatttccaaatatggagttagggatggctccatgaggtaagtgacagtttgagctaagtcttgaaggatgcttggcagctagaaccatattttccatattcaggaattcaaatttgcctttattcagctagagagaaagagagaagggggtgtgggggagaaggaaaagagaattttcacacattttgaagttcctgagagcatttctgaggatatctgccgttagtgcagaaggtcgaaaccccaagtgcccccactaaacccaggctctttagctgtaaactgccatgcagtggcaggcctgcagccttcctgatgggaccacatggacagtggcacatgggacatttggctactcgttagcttaaacaactcagtcctgtgtcttctggttttgacaagaccacatttaggactgctgcccacctctgcctctttcattgagatttccgccttattgggtccctgtgctatgccacagataccaggtttggggttgttttgacccagaaggcattgggagtcccacattacagagcacacacacagctcaacacagccatttccctggccagaggcaccaagactgaagttcaggcccttagacactaggtggcagcggtgtggctgtgcagagccaaggatgaacctgagagcttgtttgcctctggctgggcactcttgttttgaattcctttgcccttatcgtgtagtccacggccttggtgaccaaggaccacctggctagcctgcttacatgcatgaccccatccaggttcacaggtattgccactgagtgatcttaggtagatcactgctcctggagaagcagagttgaggagtgtaagacaagggccatctagtgccaatgttccttgattcttatttgaggagctactatgtggtctttctgtaaacaagtgaacaaccaatgagactaaatatttgcaatagataggctaaggaatttgggttgagacaggagacggaggaaaaatgctttgatacaatgacagatggttagtctcttcagatttccctgaatattttccatcccgacaatatgcctcttagatacttgcagattagacatgtctctggatggaccacaagatacattcacaacatgtgttcagccttgagccctggctgtgtcctgtctggaaggaactgaggatgatgtggctataaagaggaggcagtgagctggcatgtgactgccttctgtgggcctgacctgtttgacatttgagggcctatgatgtgctaggtgctgtgttaggtacttccaaatgctttatctcattttaccccagtgcaagtgtgatatagtgaggatggtgaagacgtgggtatggttaagtcatgagttcagatcccgtgcttccaattacatgggtgttttcaaacaagtcactacttatgagtttcctcatctgtgaagggaagtttagtcatctgtttcaatgtggagacacacaggattgagggagtcctccgtcacagggtgactgtctggattctatgaggaaatacttggaaagcatgcagcacaatgcctggggtgcagctgaagctgagccactggtgtttcttcacagtatctctgtggggagggtgtattattcctttttatagggatctctataatgaagtgagaatcttgaaaatataagtgttatcctagatgggaggtgttaaaggtttttgccttgggaattttgtcatatttgttgcacagcaaggaaggactttcagaaaagcagggatgtggtgaggaagagcaggcaatagagagcagggaggaaaggctaagtagcatctggaacttgagaagtctaagggagccaaaatgagattttctattaaaaatgtctatcctcagccgggcgtggtagctcacgcctgtaatcccagcactttggggggtcgagatgggcagatcacctgaggtcaggagttcgagaccagcctgaccaatatggagaaaccccgtctctactaaaaatacaaaattagttgcgcgtggtggtgggcgcctgtaatcccagctactcaggagcctgaggcaggagaatcacttaaacccaggaggcggaggttgcagtgagccgagatcgcgccattgcactccagcctgggcaacaagagcgaaaccccgcctaaaaaaagaaaaaaaagaaaaagtctatcctctatgctactggcctgtttgtacaaagataaaatcattctaatttgtccggaatgactatcaaagatgatcaaatccccagggcctggtgtaacgttccaaatcatagcacaaatacagcttgaccttccttacagtccagaaaggacattctccctgagaaatgcccttggttgctgaggacagctctgtcctgtagtgacagagtgactgcctggctgtggctcttgggttcacagaatccctaatcctccaagcccctaagaggcagggcagggatgctacccacaatatatgcagaaccccagatggagcctgtgggagagagaggaaattaccgtcttcactgtaggcaaaggagaatggctgtgattagccatatatgcctataagaaggagcagagccatactgtccttgtgggttgggagaggggacacagaatccagggcaattgtctgaggtctcaaagtaagttaagccagagtcaaagccaaactccaagtcttggccaaggggatgagaaaagcaaggagctagtcttataggtcaaggaagatgaggtatagttaagagtcatcagtatcacagaacaggccagcagggctttattaggtatgtagaactattataaaccaaggatcttgggagatattaatatctgctggccagacctaaaaaaaactgaaggcccaaggaaagtgactggactcactggaaagtatctaacaaatactttggattccaaagtatttccaataccttgaagattcctttgaaaacatcaaagcacaaactcaaatctgcacaagattacaaaagcacaattttggtgttatttttagaatgcaatacacaaagctatgttcatttctctcagcaagcattttcctgggtagtagtaatagcttaggaatcaaatgccacttttgtttttccttttttcactagtttgaaataccacaaatcacaggtgagtcagtcctcccagaggaaaagacagtcctagggagaatcacaggcctggcagacaagaccacactgagagcagtagaaggaacctgcatgcttaagggacagaggactgtgttgtgttctcataatagaccgctggatgaagaagtggttaaaaaccaaccctcgaaaaacaaaaatccctggctaatcctgaaatatatttaacttgaagtctttggatgatttttttaaggttaaaaaaaagtttaggattattataaatcaatatttataaataagcaacaatgtatttggaatttttgtttacctgattaaatatgtttttggtatgtgt

SEQ ID NO: 8781 - DNA, 460 bp, Homo sapiens
  ENST00000473300
tgcatctctctgcagtggagagaagcgacaagatgcttattgattccacagtaggaagagtgagagactgcagcagcctctaagcagcactacatgttccatacattagcagtactgctgaaacaatggcacactacagacacatattttcattaaggtcattttcgaagagatgtttatgaccctcttcccccagtcctctactaacaagtgaacaaaatgaatcaatccaaactggaaatgcttcaactacatcaagaatttatcaaatctttagcagagggccaatagcagctaattcagtatttacaactgacaatatgaagaatgcaattgactgagcatctccctagctgtctgaactacgaactgcaagatgttcttgtaacacgactttaagacattaaggagttaaaaccagggaataggtctacattactgatggaatataaaaaatcaa

SEQ ID NO: 8782 - DNA, 2942 bp, Homo sapiens
  ENST00000304402
attctgcaaaagctgcccgaacaggctttcctctgaaaagcagtgccgttcctttttagaaagactgaatctaaatgttgtctctggagacaagaagccttcagtatgttaaattactttcattatgtattttcagatgcttattgattccacagtaggaagagtgagagactgcagcagcctctaagcagcactacatgttccatacattagcagtactgctgaaacaatggcacactacagacacatattttcattaaggtcattttcgaagagatgtttatgaccctcttcccccagtcctctactaacaagtgaacaaaatgaatcaatccaaactggaaatgcttcaactacatcaagaatttatcaaatctttagcagagggccaatagcagctaattcagtatttacaactgacaatatgaagaatgcaattgactgagcatctccctagctgtctgaactacgaactgcaagatgttcttgtaacacgactttaagacattaaggagttaaaaccagggaataggtctacattactgatggaatataaaaaatcaactgtatcctaagaagatgctacataaaataaccacaaaaagaaaaacaatataactgtaaaagcctgaaaagaatttttaaaaggggaagtttatactttcatataccagaattgtggaagttactgattctggaagacataatgaaacatgaatttccaaaaagaaaagaaaatactttatcagcacacaaaaggaagatttaggaagtgttttctgcactaaatattcagatattcatatcaattggtatgactaatggatttttctatctgacttttatgaccaattatgtatcctcttctaatgaaaacaaacaaaattaaacagcagatggtttttatcaaaaggacatggcctggatttataatataaagcaagttatgtgatcaagaaatcatttcaaaatagtgagcactgctattaaaaacagatttacaatggtaacaaaaggatgtctaaatatattttagaagctacaaacgttatgtttccttttttgttttcacatattctggaaaataaagaaatattatcatgtactccatcaaagggaaacataattcctatcatctgaggaaattcctcttggccgtgactttttaaagcaaaacaaatacaaatattatgtactgttctttagaaatccatcagccaactaaatctcataatgcatgcagttgaagtattggagagaaaacgaaagaattcctacaagacatgaaataaaacacagctacttcactgttgtcagggaaaaaaaccaactgctccaaaagaatgtgtttttctcccattctggaaatcaacatgcagtctgaatctaacattacagtgcgagatgacattgatgacatcaacaccaatatgtaccaaccactatcatatccgttaagctttcaagtgtctctcaccggatttcttatgttagaaattgtgttgggacttggcagcaacctcactgtattggtactttactgcatgaaatccaacttaatcaactctgtcagtaacattattacaatgaatcttcatgtacttgatgtaataatttgtgtgggatgtattcctctaactatagttatccttctgctttcactggagagtaacactgctctcatttgctgtttccatgaggcttgtgtatcttttgcaagtgtctcaacagcaatcaacgtttttgctatcactttggacagatatgacatctctgtaaaacctgcaaaccgaattctgacaatgggcagagctgtaatgttaatgatatccatttggattttttcttttttctctttcctgattccttttattgaggtaaattttttcagtcttcaaagtggaaatacctgggaaaacaagacacttttatgtgtcagtacaaatgaatactacactgaactgggaatgtattatcacctgttagtacagatcccaatattctttttcactgttgtagtaatgttaatcacatacaccaaaatacttcaggctcttaatattcgaataggcacaagattttcaacagggcagaagaagaaagcaagaaagaaaaagacaatttctctaaccacacaacatgaggctacagacatgtcacaaagcagtggtgggagaaatgtagtctttggtgtaagaacttcagtttctgtaataattgccctccggcgagctgtgaaacgacaccgtgaacgacgagaaagacaaaagagagtcttcaggatgtctttattgattatttctacatttcttctctgctggacaccaatttctgttttaaataccaccattttatgtttaggcccaagtgaccttttagtaaaattaagattgtgttttttagtcatggcttatggaacaactatatttcaccctctattatatgcattcactagacaaaaatttcaaaaggtcttgaaaagtaaaatgaaaaagcgagttgtttctatagtagaagctgatcccctgcctaataatgctgtaatacacaactcttggatagatcctaaaagaaacaaaaaaattacctttgaagatagtgaaataagagaaaaatgtttagtgcctcaggttgtcacagactagagaaaagtctcagtttcaccaaatccacattcaaatgagttttaaatttaaattgtaaaaactgatattactgccaaatataagaaaaatattttaagtattggttatgttgtaaattttcaatgtgaatgtcaattagataggtcatatatattcaatttcttcattacttaatgtatttgttgcatggcagtttgttaaagtactatcatgtgtatattttgtcaatattatgtccaacagaaaatattcatgtaagtcatattttttaaggaataaatacatagccttaaaaca

SEQ ID NO: 8783 - DNA, 1845 bp, Homo sapiens
  ENST00000496754
ctctaagcagcactacatgttccatacattagcagtactgctgaaacaatggcacactacagacacatattttcattaaggtcattttcgaagagatgtttatgaccctcttcccccagtcctctactaacaagtgaacaaaatgaatcaatccaaactggaaatgcttcaactacatcaagaatttatcaaatctttagcagagggccaatagcagctaattcagtatttacaactgacaatatgaagaatgcaattgactgagcatctccctagctgtctgaactacgaactgcaagatgttcttgtaacacgactttaagacattaaggagttaaaaccagggaataggtctacattactgatggaatataaaaaatcaactgtatcctaagaagatgctacataaaataaccacaaaaagaaaaacaatataactgtaaaagcctgaaaagaatttttaaaaggggaagtttatactttcatataccagaattgtggaagttactgattctggaagacataatgaaacatgaatttccaaaaagaaaagaaaatactttatcagcacacaaaaggaagatttaggaagtgttttctgcactaaatattcagatattcatatcaattggtatgactaatggatttttctatctgacttttatgaccaattatgtatcctcttctaatgaaaacaaacaaaattaaacagcagatggtttttatcaaaaggacatggcctggatttataatataaagcaagttatgtgatcaagaaatcatttcaaaatagtgagcactgctattaaaaacagatttacaatggtaacaaaaggatgtctaaatatattttagaagctacaaacgttatgtttccttttttgttttcacatattctggaaaataaagaaatattatcatgtactccatcaaagggaaacataattcctatcatctgaggaaattcctcttggccgtgactttttaaagcaaaacaaatacaaatattatgtactgttctttagaaatccatcagccaactaaatctcataatgcatgcagttgaagtattggagagaaaacgaaagaattcctacaagacatgaaataaaacacagctacttcactgttgtcaggtaaaaattcatgtcaaaatctgtcaatgatatcatgtatcaatttgccaaaaactgtcatagtgaaccaaaaggcccataaggcaacagcaaacaggtaggtcagaagatgcatgcaccccaccacactgtttaacatttacgaaagaacagaatcttgctctagagaaaatgtatttttcttaatcatcatttaacttgacatttctgctttatttaattataaatctaactgatgtgacaaagacctgatgtttaatctgtcagttcagaaaatttggcacacttaaaattttccatttttataggatttcaatgttagctaagaccttaacttactcgaataaatatacctctagtaatacttcatactaattcaaaagaaataatgttaccatttgtgtttctgcaatattattcccaaaaaagttcataaataaaactgtattctaaaacttgtcaaatataacattaagtgaaagttaacatgaattttgaaaattattagcttttataatttatgttgaatatgattttgcagttgaaatgctgtatttgaaatgtgaaatatagttggttgtatgagttcatattttaaaatgaatatactgattaactgacattttagcccagaacattagacattattttttacaaattattctaaacccctatatattaaaatatagatttgcatgaattagcaaaa

SEQ ID NO: 8784 - DNA, 460 bp, Homo sapiens; identical to SEQ ID NO: 8781
  ENST00000638179

SEQ ID NO: 8785 - DNA, 2942 bp, Homo sapiens; identical to SEQ ID NO: 8782
  ENST00000639742

SEQ ID NO: 8786 - DNA, 1845 bp, Homo sapiens
  ENST00000640321
ctctaagcagcactacatgttccatacattagcagtactgctgaaacaatggcacactacagacacatattttcattaaggtcattttcgaagagatgtttatgaccctcttcccccagtcctctactaacaagtgaacaaaatgaatcaatccaaactggaaatgcttcaactacatcaagaatttatcaaatctttagcagagggccaatagcagctaattcagtatttacaactgacaatatgaagaatgcaattgactgagcatctccctagctgtctgaactacgaactgcaagatgttcttgtaacacgactttaagacattaaggagttaaaaccagggaataggtctacattactgatggaatataaaaaatcaactgtatcctaagaagatgctacataaaataaccacaaaaagaaaaacaatataactgtaaaagcctgaaaagaatttttaaaaggggaagtttatactttcatataccagaattgtggaagttactgattctggaagacataatgaaacatgaatttccaaaaagaaaagaaaatactttatcagcacacaaaaggaagatttaggaagtgttttctgcactaaatattcagatattcatatcaattggtatgactaatggatttttctatctgacttttatgaccaattatgtatcctcttctaatgaaaacaaacaaaattaaacagcagatggtttttatcaaaaggacatggcctggatttataatataaagcaagttatgtgatcaagaaatcatttcaaaatagtgagcactgctattaaaaacagatttacaatggtaacaaaaggatgtctaaatatattttagaagctacaaacgttatgtttccttttttgttttcacatattctggaaaataaagaaatattatcatgtactccatcaaagggaaacataattcctatcatctgaggaaattcctcttggccgtgactttttaaagcaaaacaaatacaaatattatgtactgttctttagaaatccatcagccaactaaatctcataatgcatgcagttgaagtattggagagaaaacgaaagaattcctacaagacatgaaataaaacacagctacttcactgttgtcaggtaaaaattcatgtcaaaatctgtcaatgatatcatgtatcaatttgccaaaaactgtcatagtgaaccaaaaggcccataaggcaacagcaaacaggtaggtcagaagatgcatgcaccccaccacactgtttaacatttacgaaagaacagaatcttgctctagagaaaatgtatttttcttaatcatcatttaacttgacatttctgctttatttaattataaatctaactgatgtgacaaagacctgatgtttaatctgtcagttcagaaaatttggcacacttaaaattttccatttttataggatttcaatgttagctaagaccttaacttactcgaataaatatacctctagtaatacttcatactaattcaaaagaaataatgttaccatttgtgtttctgcaatattattcccaaaaaagttcataaataaaactgtattctaaaacttgtcaaatataacatcaagtgaaagttaacatgaattttgaaaattattagcttttataatttatgttgaatatgattttgcagttgaaatgctgtatttgaaatgtgaaatatagttggttgtatgagttcatattttaaaatgaatatactgattaactgacattttagcccagaacattagacattattttttacaaattattctaaacccctatatattaaaatatagatttgcatgaattagcaaaa

SEQ ID NO: 8787 - DNA, 1928 bp, Homo sapiens
  ENST00000378142
aaccaattgcaccacgaccggatggaagagcccagctgacacaaccaagacgagtctcagtgtctagggaagcttggggttctgctccttttacttcaggcgaacctgaactcagttaatgcaattttgaagcatgccctgaatagattcagtcattatcaagtcaaactaaaaacggtgaaaggttgcgactattaccaaataggaaaaatctgaagacataagaactacacatgaggaatatgtcatttagcactttcactttttgatctccacagaagacaatgagaagtcataccataacaatgacgacaacttcagtcagcagctggccttactcctcccacagaatgcgctttataaccaatcatagcgaccaaccgccacaaaacttctcagcaacaccaaatgttactacctgtcccatggatgaaaaattgctatctactgtgttaaccacatcctactctgttattttcatcgtgggactggttgggaacataatcgccctctatgtatttctgggtattcaccgtaaaagaaattccattcaaatttatctacttaacgtagccattgcagacctcctactcatcttctgcctccctttccgaataatgtatcatattaaccaaaacaagtggacactaggtgtgattctgtgcaaggttgtgggaacactgttttatatgaacatgtacattagcattattttgcttggattcatcagtttggatcgctatataaaaattaatcggtctatacagcaacggaaggcaataacaaccaaacaaagtatttatgtctgttgtatagtatggatgcttgctcttggtggattcctaactatgattattttaacacttaagaaaggagggcataattccacaatgtgtttccattacagagataagcataacgcaaaaggagaagccatttttaacttcattcttgtggtaatgttctggctaattttcttactaataatcctttcatatattaagattgggaagaatctattgaggatttctaaaaggaggtcaaaatttcctaattctggtaaatatgccactacagctcgtaactcctttattgtacttatcatttttactatatgttttgttccctatcatgcctttcgattcatctacatttcttcacagctaaatgtatcatcttgctactggaaagaaattgttcacaaaaccaatgagatcatgctggttctctcatctttcaatagttgcttagatccagtcatgtatttcctgatgtccagtaacattcgcaaaataatgtgccaacttctttttagacgatttcaaggtgaaccaagtaggagtgaaagcacttcagaatttaaaccaggatactccctgcatgatacatctgtggcagtgaaaatacagtctagttctaaaagtacttgaggtaaacatactaaaatgaattatataatgcagcctcttaattctttgaagaactaaaaaattaggaaacaaagttctagcatttacaaaactcagatctcaaagctctgcttgtatttgtgatatttcatttgcttaactgtaaaccatttcaaggtactaacttttaaatctgtatgtaaaatcttttcaaaatacatttttaagctaatactcttaacatagattatgaagttaagtgaaatttatggctctaacagcaaaataattaaagtgccatagtttctcaagtgactaaagtagttattaaaatcaagcacttgatactaatttgaagtgtgtttaaaagtaaatgatttgggaactgacaatgtgtcagaaaatatatgttcatttatcattttaaaatcttgtataatttgccactgtattcatttatgcctaaatctctataacagatgaaaagataattaataaaatcctaattaaaaaatgaga

SEQ ID NO: 8788 - DNA, 1815 bp, Homo sapiens
  ENST00000378138
agctgacacaaccaagacgagtctcagtgtctagggaagcttggggttctgctccttttacttcaggcgaacctgaactttaatgcaattttgaagcatgccctgaatagattcagtcattatcaagtcaaactaaaaacggtgaaaggttgcgactattaccaaatagaagacaatgagaagtcataccataacaatgacgacaacttcagtcagcagctggccttactcctcccacagaatgcgctttataaccaatcatagcgaccaaccgccacaaaacttctcagcaacaccaaatgttactacctgtcccatggatgaaaaattgctatctactgtgttaaccacatcctactctgttattttcatcgtgggactggttgggaacataatcgccctctatgtatttctgggtattcaccgtaaaagaaattccattcaaatttatctacttaacgtagccattgcagacctcctactcatcttctgcctccctttccgaataatgtatcatattaaccaaaacaagtggacactaggtgtgattctgtgcaaggttgtgggaacactgttttatatgaacatgtacattagcattattttgcttggattcatcagtttggatcgctatataaaaattaatcggtctatacagcaacggaaggcaataacaaccaaacaaagtatttatgtctgttgtatagtatggatgcttgctcttggtggattcctaactatgattattttaacacttaagaaaggagggcataattccacaatgtgtttccattacagagataagcataacgcaaaaggagaagccatttttaacttcattcttgtggtaatgttctggctaattttcttactaataatcctttcatatattaagattgggaagaatctattgaggatttctaaaaggaggtcaaaatttcctaattctggtaaatatgccactacagctcgtaactcctttattgtacttatcatttttactatatgttttgttccctatcatgcctttcgattcatctacatttcttcacagctaaatgtatcatcttgctactggaaagaaattgttcacaaaaccaatgagatcatgctggttctctcatctttcaatagttgcttagatccagtcatgtatttcctgatgtccagtaacattcgcaaaataatgtgccaacttctttttagacgatttcaaggtgaaccaagtaggagtgaaagcacttcagaatttaaaccaggatactccctgcatgatacatctgtggcagtgaaaatacagtctagttctaaaagtacttgaggtaaacatactaaaatgaattatataatgcagcctcttaattctttgaagaactaaaaaattaggaaacaaagttctagcatttacaaaactcagatctcaaagctctgcttgtatttgtgatatttcatttgcttaactgtaaaccatttcaaggtactaacttttaaatctgtatgtaaaatcttttcaaaatacatttttaagctaatactcttaacatagattatgaagttaagtgaaatttatggctctaacagcaaaataattaaagtgccatagtttctcaagtgactaaagtagttattaaaatcaagcacttgatactaatttgaagtgtgtttaaaagtaaatgatttgggaactgacaatgtgtcagaaaatatatgttcatttatcattttaaaatcttgtataatttgccactgtattcatttatgcctaaatctctataacagatgaaaagataattaataaaatcctaattaaaaaat

SEQ ID NO: 8789 - DNA, 1282 bp, Homo sapiens
  ENST00000620846
ggttctgctccttttacttcaggcgaacctgaactcagttaatgcaattttgaagcatgccctgaatagattcagtcattatcaagtcaaactaaaaacggtgaaaggttgcgactattaccaaataggaaaaatctgaagacataagaactacacatgaggaatatgtcatttagcactttcactttttgatctccacagaagacaatgagaagtcataccataacaatgacgacaacttcagtcagcagcaacaccaaatgttactacctgtcccatggatgaaaaattgctatctactgtgttaaccacatcctactctgttattttcatcgtgggactggttgggaacataatcgccctctatgtatttctgggtattcaccgtaaaagaaattccattcaaatttatctacttaacgtagccattgcagacctcctactcatcttctgcctccctttccgaataatgtatcatattaaccaaaacaagtggacactaggtgtgattctgtgcaaggttgtgggaacactgttttatatgaacatgtacattagcattattttgcttggattcatcagtttggatcgctatataaaaattaatcggtctatacagcaacggaaggcaataacaaccaaacaaagtatttatgtctgttgtatagtatggatgcttgctcttggtggattcctaactatgattattttaacacttaagaaaggagggcataattccacaatgtgtttccattacagagataagcataacgcaaaaggagaagccatttttaacttcattcttgtggtaatgttctggctaattttcttactaataatcctttcatatattaagattgggaagaatctattgaggatttctaaaaggaggtcaaaatttcctaattctggtaaatatgccactacagctcgtaactcctttattgtacttatcatttttactatatgttttgttccctatcatgcctttcgattcatctacatttcttcacagctaaatgtatcatcttgctactggaaagaaattgttcacaaaaccaatgagatcatgctggttctctcatctttcaatagttgcttagatccagtcatgtatttcctgatgtccagtaacattcgcaaaataatgtgccaacttctttttagacgatttcaaggtgaaccaagtaggagtgaaagcacttcagaatttaaaccaggatactccctgcatgatacatctgtggcagtgaaaatacagtctagttctaaaagtacttga

SEQ ID NO: 8790 - DNA, 3021 bp, Homo sapiens
  ENST00000303921
ggggttggaatcccgcttctcctcggcagcagtaggctcgcaagtcgctggggttaggtggggcaagagtttcgccggcgcatcagcgctgcttcggactgtttgcaacgtgtttccagcgagctgggagcggggttgtgactgcgagtcgtctgggggagggggacttgtttttcttttcctctagagacctcggcttgcaactggatcaaacgctgtcgaaaggatgtaaataggcagagcaactgttaccaagaaggccaccacccccacccaaaggcagtgaggagtgtggggcttcgtctgggctcccccgagtctcaacagtaatcaacagtcaggtgttgattgcaacttttcaaggtcagccaccgggagtagcctattccctctaggaaccttggagggcataccttgctgggactcaacttggctgagaaatgcacaagatgccaaaggaggaaggattatagggggcgtgtgtgtgacccccaagaccgatcttccgctatcaccctaatctccggttccccgctacccgggcgggggtgagtatgtgacatgtgcctaactctcagcagcaacttcggcagcaggtgtcgatcctaactaagcaggagctgcggctgccgggtgtgccctcaccaagccatgcgagccccgggcgcgcttctcgcccgcatgtcgcggctactgcttctgctactgctcaaggtgtctgcctcttctgccctcggggtcgcccctgcgtccagaaacgaaacttgtctgggggagagctgtgcacctacagtgatccagcgccgcggcagggacgcctggggaccgggaaattctgcaagagacgttctgcgagcccgagcacccagggaggagcagggggcagcgtttcttgcgggaccctcctgggacctgccggcggccccgggccgtgacccggctgcaggcagaggggcggaggcgtcggcagccggacccccgggacctccaaccaggccacctggcccctggaggtggaaaggtgctcggggtcaggagccttctgaaactttggggagagggaaccccacggccctccagctcttccttcagatctcagaggaggaagagaagggtcccagaggcgctggcatttccgggcgtagccaggagcagagtgtgaagacagtccccggagccagcgatcttttttactggccaaggagagccgggaaactccagggttcccaccacaagcccctgtccaagacggccaatggactggcggggcacgaagggtggacaattgcactcccgggccgggcgctggcccagaatggatccttgggtgaaggaatccatgagcctgggggtccccgccggggaaacagcacgaaccggcgtgtgagactgaagaaccccttctacccgctgacccaggagtcctatggagcctacgcggtcatgtgtctgtccgtggtgatcttcgggaccggcatcattggcaacctggcggtgatgtgcatcgtgtgccacaactactacatgcggagcatctccaactccctcttggccaacctggccttctgggactttctcatcatcttcttctgccttccgctggtcatcttccacgagctgaccaagaagtggctgctggaggacttctcctgcaagatcgtgccctatatagaggtcgcttctctgggagtcaccactttcaccttatgtgctctgtgcatagaccgcttccgtgctgccaccaacgtacagatgtactacgaaatgatcgaaaactgttcctcaacaactgccaaacttgctgttatatgggtgggagctctattgttagcacttccagaagttgttctccgccagctgagcaaggaggatttggggtttagtggccgagctccggcagaaaggtgcattattaagatctctcctgatttaccagacaccatctatgttctagccctcacctacgacagtgcgagactgtggtggtattttggctgttacttttgtttgcccacgcttttcaccatcacctgctctctagtgactgcgaggaaaatccgcaaagcagagaaagcctgtacccgagggaataaacggcagattcaactagagagtcagatgaactgtacagtagtggcactgaccattttatatggattttgcattattcctgaaaatatctgcaacattgttactgcctacatggctacaggggtttcacagcagacaatggacctccttaatatcatcagccagttccttttgttctttaagtcctgtgtcaccccagtcctccttttctgtctctgcaaacccttcagtcgggccttcatggagtgctgctgctgttgctgtgaggaatgcattcagaagtcttcaacggtgaccagtgatgacaatgacaacgagtacaccacggaactcgaactctcgcctttcagtaccatacgccgtgaaatgtccacttttgcttctgtcggaactcattgctgaaggacagtacttggttgggtcagatttatttgtttgattttcatatcccgtgaaagtttttaattcatatttttccttatagggaaaaatgcaaaaaagaaacaataaagaaagaaatattaactactgtagaactgattttacaaattaatatttgtgctttgaaaaaaagtttctatttagttatttaagaagaatgagaaggccaatagttttagattattttatctggtatggtgctaatattttatttgaaaaaagttactgcaacttaacttaaaattgctaacgttttttcttcttttaaaaatacaattattgtatattgattatagcaatgtgattttgtaggttattttatatttgagttgtgattgaaagtatgttgtatatggtattgtgagatgatttgtacttggaagcattcacaaagtagcaccaaataaattacactttattctttaatgtcattgtcaatctacttttaaccaatattcaataaatcttctaattgccttaaagatacaa

SEQ ID NO: 8791 - DNA, 6588 bp, Homo sapiens
  ENST00000367282
gactggaggcggatccagccggccagctgcctctctggagcccagctcttgggccccctgcactcacctgctcttcctgggctggctgtctcctgctcatccagccatgcggtggctgtggcccctggctgtctctcttgctgtgattttggctgtggggctaagcagggtctctgggggtgcccccctgcacctgggcaggcacagagccgagacccaggagcagcagagccgatccaagaggggcaccgaggatgaggaggccaagggcgtgcagcagtatgtgcctgaggagtgggcggagtacccccggcccattcaccctgctggcctgcagccaaccaagcccttggtggccaccagccctaaccccggcaaggatgggggcaccccagacagtgggcaggaactgaggggcaatctgacaggagcaccagggcagaggctacagatccagaaccccctgtatccggtgaccgagagctcctacagtgcctatgccatcatgcttctggcgctggtggtgtttgcggtgggcattgtgggcaacctgtcggtcatgtgcatcgtgtggcacagctactacctgaagagtgcctggaactccatccttgccagcctggccctctgggattttctggtcctctttttctgcctccctattgtcatcttcaacgagatcaccaagcagaggctactgggtgacgtttcttgtcgtgccgtgcccttcatggaggtctcctctctgggagtcacgactttcagcctctgtgccctgggcattgaccgcttccacgtggccaccagcaccctgcccaaggtgaggcccatcgagcggtgccaatccatcctggccaagttggctgtcatctgggtgggctccatgacgctggctgtgcctgagctcctgctgtggcagctggcacaggagcctgcccccaccatgggcaccctggactcatgcatcatgaaaccctcagccagcctgcccgagtccctgtattcactggtgatgacctaccagaacgcccgcatgtggtggtactttggctgctacttctgcctgcccatcctcttcacagtcacctgccagctggtgacatggcgggtgcgaggccctccagggaggaagtcagagtgcagggccagcaagcacgagcagtgtgagagccagctcaacagcaccgtggtgggcctgaccgtggtctacgccttctgcaccctcccagagaacgtctgcaacatcgtggtggcctacctctccaccgagctgacccgccagaccctggacctcctgggcctcatcaaccagttctccaccttcttcaagggcgccatcaccccagtgctgctcctttgcatctgcaggccgctgggccaggccttcctggactgctgctgctgctgctgctgtgaggagtgcggcggggcttcggaggcctctgctgccaatgggtcggacaacaagctcaagaccgaggtgtcctcttccatctacttccacaagcccagggagtcacccccactcctgcccctgggcacaccttgctgaggccccagtaggggtggggagggagggagaggccgccacccccgccggtgtctgctgttctttccccataggtcttgctttgttgcctgtcttgctgtctagggatggacttggttcctcttgtcaaggtttgggaatgtcaaagccccctccccacacagggcctttcctgtcccttgtggggccttccaaccctgtcctttccactggtgggcggtgatgcttctaggtccttagaactgcccagaaactctgagtcccagcagctgggagccagaactttgcctgccctcccttggttccagtctctcttctctctctctgccttggaacctgaccatactttagttgtgcccttcccaggcatcatcctcctaccaccaacctggggccccatcttggaatgggggctccttggggccagcccagtgtggctcaccacactcttctttttttttttttttttttttgagatggagtcttgctctgttgcccaggctggagtacatttgcctgatgtcagctccctgcaacctccgcctcctgggttcaagcgattctcctgcctcagcctcctgagtagctgggattacaggtgtgcaccaacacacccggctaatttttgtatttgtagaagaggcggggtttcaccatgttggccaggctggtgttgaactcctgacctcaagtgatctgcctgccttggcctcccaaagtgctgggattacaggtgtgagctgccacgcccagccccagtacactcttctctggaccagatctgtcccagtcctggatgcctcctcctactggtgccttcttttcttccagaggatttctctctccttcctcctcctttctttgggatccctgggttgccctgtcccaacctccttgttaggtgctttcccataggaggcccttcttgagaaacaataaactaggtagaactacccctatgcccatccactttcttgtgccacattctggcagggcccagatgcagctgggccttcctggcctggcagtgcctaggagaatttctcctgacctggcctggcctgtggctgatgttcagaacagccttgtggccgatgttcagaacagccttgtggccctggcgactccaagggttttatggcttttgagggacagagaggatggagggcttggggagccggaggacctaagtcctcatcctggcctaaaccccatgctccttgggaagtcaaaagcctggaaaatatctcctctggagccttcatctctgctatgccctctctccacaaagccccccttggagggagtccagtggtctttcctctgtgagccccagggcttcccagcctttgtcactctgagagctgctcttgttcagtttcttagaatggactgttttgcctgtagacggcccagctgcctgccctggcctgcccccacccagcccccactgcaccacccttcccgccagagctcccactgcccccggcagacccttcatgcagcttctcctgtggggtcttgcccttgaagtgccacttcccccagccccacctctggtcccttccagagggcacccttagccttgtaggtccctgggaagctggcacagcatcaaccagaagtgatgcctcagccaggccaccagtcgctccccgcctgggagctcagctttcctcagaaccaccccccctgtctgaagctctgtcctgggtcccaccagacttctgcccaccaggcctacctacagcatccacatggggcctcaggaagggccccgggggcccagggatgggcaggggcagggtttccaagcgcctggggctccattctcctctgtccacccacccacaccccttggcctcagcctgccctgtacccaagcttccctccccctctcctggggatcttaacggccttgttctctctccctggcacccacccccagggcgggtgatgccgccaagagagagggaggccgttgctaggtgatggcgccgccatgcacacaccctttgtgctggggagtgacacccacccgtttctcagcagacctgttgccacggtgactgaagcccccagctctgtctgtagaaacttcagatgggtgggggagcaggttggagaggggaccaaaggcaggcctgtcgtgctgaagctcttggggaccgtttcctcggcatttccccaactccttctccacccccctgccaggcccggaagtaccaccagcttcctaagggatgcaggaaggggccgggtgaactgaggtgaagtccagggcaggggagtcagacccctcaacatcctgtttaggggtcctcctccacaaagggtgccctccacctctccctcctgctggttggccggctcagagatgaagggggagagatggtggctccaaggctctgccaccgccacctcccaagcctgccaacgtgaatggcttgcagaatcagtcagcaggccagcggccttgggaaagagccactgtcctcgcagcctgggccagctgggggaacaatgtagggtttgttgcttaggggtcccaggcttgcgggggggttggcacatggtgggcagtggacttgagctgggatggtctgagggggcactgacacgctcacccgagggcagacttcagaccagccctcagatcctgatgccaggttacagggctgaggggagcctgaaatccactgggtctccctgctccacttgggagtcaccttctcatcacctatcctggaactgaatgcaattacttaaactcagtctcagcttcctcatctgtaaaatgggaataatctgtccttcacagaggattatggtcatttaatgagacaagatacataaagcactttgcatggtgccccgaaccttttattccttcctctcctttgggaattcaattctctagtgttaggagcaggcttggcccagggattcttaaatgcatccaggttttggcatcaaagggccccaaacatgacaatttacctatactcatggtctgttcccattcaactttaataggttatgtgtgttttttttttcttaagagctgggtgggggggtctcactatgttgcccaggctggctttgaactcctgggctcaagcagtcctcctgtctcagcctcctgagtagctgggactacaagtgtgtaccaccatgcctggctgaacacttttttttttttgagacaagatcccactcagtcactcaagctgagtgctgtggtgtgatcacagctcattgcagcctccacttcctgggctcaagcgattctcctgcctcagcttcctgagtagctgggactacaggtgcgcactaccacgcctgtctaatttttgattatttgtagagatagggtctcactattttgcccaggctggtctcaaactcccagactcaagtcattctcctacctcgggctcccaaagtactgggattacaggcatgagcacctggcccctgaacaaattctttaagtcatattagcacctgctgcacgccggcactgtggaaggaggatgcttgcttgcttcctggtaaccagctctcttatctcaaacctcaatcctcagtgaggatcacaggatctgagaaaggcaccttggcctggaaacagccccagatgagtgagattgctggtcctctcccgggatcccaggcccaggaaaacctagccatgcttgcagtcaggagagggcaggggatagagccctggctcccattcaacctccttagccaggaggacatgtcccattttgcttaggagttgggaggtaccctagaatcacttagcttcagatgccaaattccatccacattctttcctccaactctctggcagtggggaactgcctctccaggcagggaactgctctgacaggtctgatgactgcctccaggaggaagccctgggcaccaatgaaggtgaggggctggagggcccaggacggggagtcaaggtccccactcccaggactaagggacagtttggctcctttttcctgcagtgggaggggtgagaagggctggggtgttctgcaagggcctgctccattttccagggtgaaggagaggccgagggaggtggagcgggaggaggtggggcttactgtgaaactgggtcaagatggcctcggatttgagcaggcagggtcaccaggctctgaggcagcagctgtgagcagtgccgagggaggaccagctctgacggtgaggtcgggtgggggactagaatccagcagaggagcgagggcagggctcctaccaggaaacccatagcattgacactaactgagaggcagcaaaggcggtgacactcccccaggctctgtgggcccagccctacccctgaagcacagttaactggttctggggtaggaactgggggccggagggacagggttctggttctggctcaaccttggctgctggtgagatccagggcctgggaaagaggggctgaggcctgaactgggcctaaggagagtgcagctcagttcgcacacaacagcacccagccctgtccccttgctgcctctacccagccctgggcagttccctcaacagagctctgcagccccaagtggcagctgctggctcaaagctgggactacatgaaagtctgaaaagagaatgagaaggaggtggcgcaagagcctggacgcacgtgtgggaggccgttttgtgcagcgccattgtgctccccgggcgggcatgtgctcgcgctccgtggctctgttggtgcccagcgtgcgggggtgtgctggtggccctgtgggcctgtagggcaacccatgccaactgcggaaaagtaaccagcaccatacaccccccccaacacaaaactggtcatttattttttttgttgtcattgttattaggaagcaaaaaaatgtacagttacaagaatcattttccaaacagaggttaaatatgagctgaaaagtgtaaaaaaggaagaggaacatcactttacaaatcattaaattaaacaaataaacaaacagaacccaaagaaccaa

SEQ ID NO: 8792 - DNA, 5952 bp, Homo sapiens
  ENST00000229955
ctcccgccaccgccgcctgtatcgccgccgccgccaccacctcctcttcgttgtcctccttcctcctccgcctggcagcgttgttctctgcagcggaggagagaagtgctatgtcaggaaagttccgggagggactacatggagccatgctccctgggctcttccgcgggcgcccgcgcgctgcccttcgcttgaggcaaaaggactcttgtggaagatggaactcattgtccattttccagaatgtatttccaagcccatcaatgggacctgatactgctgttctgtgttgaaatgcttgaagaactcctgcatctctgcttgcatcttccatcctactgaaaccatggtcttctcggcagtgttgactgcgttccataccgggacatccaacacaacatttgtcgtgtatgaaaacacctacatgaatattacactccctccaccattccagcatcctgacctcagtccattgcttagatatagttttgaaaccatggctcccactggtttgagttccttgaccgtgaatagtacagctgtgcccacaacaccagcagcatttaagagcctaaacttgcctcttcagatcaccctttctgctataatgatattcattctgtttgtgtcttttcttgggaacttggttgtttgcctcatggtttaccaaaaagctgccatgaggtctgcaattaacatcctccttgccagcctagcttttgcagacatgttgcttgcagtgctgaacatgccctttgccctggtaactattcttactacccgatggatttttgggaaattcttctgtagggtatctgctatgtttttctggttatttgtgatagaaggagtagccatcctgctcatcattagcatagataggttccttattatagtccagaggcaggataagctaaacccatatagagctaaggttctgattgcagtttcttgggcaacttccttttgtgtagcttttcctttagccgtaggaaaccccgacctgcagataccttcccgagctccccagtgtgtgtttgggtacacaaccaatccaggctaccaggcttatgtgattttgatttctctcatttctttcttcatacccttcctggtaatactgtactcatttatgggcatactcaacacccttcggcacaatgccttgaggatccatagctaccctgaaggtatatgcctcagccaggccagcaaactgggtctcatgagtctgcagagacctttccagatgagcattgacatgggctttaaaacacgtgccttcaccactattttgattctctttgctgtcttcattgtctgctgggccccattcaccacttacagccttgtggcaacattcagtaagcacttttactatcagcacaacttttttgagattagcacctggctactgtggctctgctacctcaagtctgcattgaatccgctgatctactactggaggattaagaaattccatgatgcttgcctggacatgatgcctaagtccttcaagtttttgccgcagctccctggtcacacaaagcgacggatacgtcctagtgctgtctatgtgtgtggggaacatcggacggtggtgtgaatattggaactggctgacattttgggtgatgcttgttctttattgacattgaattctctttctcatagcctctccactttatttttttttatagggtttgtgtatgtatgtgtgtgagcagtgtaaagaaagaatggtaattatagttctgttaccaagaataaataataggaaagtgattacaaatattacctccagggttcaatagaaatcctcaatttagggtgaggagacttttttttggttttggggtttttccttgattgattttgttttcatagtgggaatcaggattgtgctttattgagcctgcagttacattgaattgtaggtgtttcgtgtgctgctaaggtatgcttatttgagtttatcaagactttttttttctggaagacactgctgcttttaccatcacattggagccaaacatctcaatcaatatatatttagttttattttaaaaactaacccaggaaggttagcgacattttaagggtcattactatttactttggtgcactttaagagataatgtacaaattaattcagtcttatttttcagaattgtttttatacatgatatgtgctttaggaaatgtgcattatcatttatgggaagatagttttaagaaatgttttatctgcatgtacagttgtaaaagagaacataaaatgtagatacttttctaagcacaatagcaactcttcaagcaatagcgcaaaatctaggagacaggatccttgcaaatttaaaaggtgaatgtagtgagggggatggcaagtggctggtacaggctgtggtgattccttttactcaagggtttttgtggagtatagggagaaggggttgatatttatggacacctatgtgtcaggcactgtgcatcattttatccttacaggatgttgtgaggtaggtattattgttttcatttttacaggtgaagaaagcaggtctcagagggactaaaatcctgcccaaggttagtggtagagctgggatccaaaaatctgtcagaatcctgagactgcgctgttccactgtgccacgcagacagttcattcagtttagatgtcacatagtcaagagggaactctatgcatcctttaattttttagactatgatattctttttaaaaattagcctttattttctaactaccaaaagaaatatgaaagcattacagaaacactggaaaatagaaaagaaaaaataaaatcacttacaaccactttttgttttttggagtctcgctttgccacccaggctggagtgcagtggtgtgatcatggctcattgtagcctcaacctcccaggctcaggtaatcctcctgtctcagcctcctgaatagctggaaccacacacacacacgcacacacaggtgtgtgccaccacacccagctatttttttgtattttcttttgtaaagacaaggtttcaccatgttgcccaggctggtctcagagtcctgagctcaaacgatctgcctgccttggcctcccaaaatgttgggattacaggcatgagccaccacatctgacctacaaccactttttaatgtgagacttaaaaatcttagataaataaggctgtgaagcaaaaccagtgatttttttttttgtttttgatttgcaaaacaagtgactgacaattattgagaaattaaagatagctatgtgtaggtcttgcccctgcgggtttggaggtttccagttgtccatctgtgttagttgtaagtgttctgggcagaatagtattgttgccccaatgcttgccctagcagagctggagtttgtgaacgtgctcagatgtgtgtctcctacaaagaagggaaaatgaaccctcgtctgagcctagaacaagttttaatagggcatgtctgacatttcaaattgtttttctcttgctgacagtctgcccccaggtgcatctagggccttggtcagcttctctgttaccagtggctcactttataaaacagcccacagggataagggctgaaaatatagccacttggctacatcattgactaattaagtaagttaactgtggatttatagcatcttttcaggatgttagtgttttgtgagccagtggaaaaaataagcttctatttcttcatttgtaaaaccagagagttggattagatgaatctctaacgtcctgtccagctcaaatgtgctttcctctatactagggtatagatttttgaagagcctagctgacttcagcatcacctcaccctttggtctccagtattacttctttacattttacttcattagctatttcttaatattaaatgtctgaagagtgtggcactgtatcaggagttggggcattgaaaggttgaagacatcatgaaatatctgggaaactctgctcttaaggaaattgcaccgatgttggaactcattgtccagttaaagagctctttggggactcaagcatattattcaacatgttgttttgggattatcttcaaatgatagtcacctacctctttcatttctaatttttattcacaggtaaaattgtttttgtccatagggattttataggacataagcactgtagtagatactagtagcattttgaagtgtattatgctctccattttccatataaactagatttcaagcagatattgataaggacattttttattagacttttctctgaggaaagtcagcatgatctgtattcatcttacatattgataggtcatgaagactcctttttggctggaggtgaaactgagctttgttttctttgttcctgttttatgggcagtctttaggtactttcatgctgcttaataggcagtgcctcatttggtgagagctctggagtgcctgccgagacgctccctgtttgtgaacaaagattatgaaggggtctttgtgagaattcagcagcaacactgaacagcagttctttttacactggattatcttgatctgatgagagtttacaaatcattttgaacatttttattatgtatacattgtgaaagctttaaaaataagtactatggagcacctttgagaaacgtaggtgcaaaatcatatgttgcctattcccccatattttcttgaggcagggaaagataccactactaattctcactgcttacaggcataatcagaaatggttttttgtttgcctgtttttccttctggctagtaagaagcgtaaaagagataatgaaatatttgtggtcaaaagaaagatgcaagggaaattccaaatagtatggagtaacattatttaaactttaatacatgtttaagcatccccaagggagcttgttaacagtacagattcctgggcctccagagggtctgtggttgagcccaggaatgtgcatttttattttattgagcactctgcctgactctggctcaggtagtccctgggaaactcttcaggaaacattcctgtagaaaatatatctatttaaatatcatctgttttatcccacaatgtttgtttcgtgttgcaagccattatcttctaggcatgggtaatccacattgagaggaaaatccacacaacattgtgcctgatttgctgccacctgtgtttgtgctggatcttgccagtgttagctttattttctttcaactggcaaaattctgataaagcatatagcttcacagtagagcaaaatgggtgacttaattgaaagtcatgactttcagcagtctaattatgctcatattttattttcttatagagagctgtctttattgtgtgtaattcccggaagaatgtaaagatttatctaattcctattgctctgccagttgtgttcaatgcaagcattgaagtaaaataaaaataacctttttaatatgtgtatttctgttgcccacaaagatatttaatttttttcttgatctttgtttttgtttatgtgaaaatatttacatatgtatcatttctgtatatatcacagaaaagttttcacttgcttgacattttattctacaatgatttttagtttaagtttaaagaatggctacattcagatttattttcacaactatagtcctgctaaactgccttcattgaaaactcagtttttatgataaaaaatatcaaagcacaagtttgttattggaggtaaattatacatttcttagatatctattggtactagacctttgtaattaaaattaatttattttacaatagtaactgacctgtatggaaaaaaaaacaaccttgaattatgggttctaatatttaaatatcgaaaaatatggttatttgtgcatattcttattacaaccaagaaaagaactcctgataagaaaataaataaatatttaacattt

SEQ ID NO: 8793 - DNA, 1497 bp, Homo sapiens
  ENST00000267015
taactgtccaccagaaaggactgctctttgggtgagttgaacttcttccattatagaaagaattgaaggctgagaaactcagcctctatcatgtggaacagctctgacgccaacttctcctgctaccatgagtctgtgctgggctatcgttatgttgcagttagctggggggtggtggtggctgtgacaggcaccgtgggcaatgtgctcaccctactggccttggccatccagcccaagctccgtacccgattcaacctgctcatagccaacctcacactggctgatctcctctactgcacgctccttcagcccttctctgtggacacctacctccacctgcactggcgcaccggtgccaccttctgcagggtatttgggctcctcctttttgcctccaattctgtctccatcctgaccctctgcctcatcgcactgggacgctacctcctcattgcccaccctaagctttttccccaagttttcagtgccaaggggatagtgctggcactggtgagcacctgggttgtgggcgtggccagctttgctcccctctggcctatttatatcctggtacctgtagtctgcacctgcagctttgaccgcatccgaggccggccttacaccaccatcctcatgggcatctactttgtgcttgggctcagcagtgttggcatcttctattgcctcatccaccgccaggtcaaacgagcagcacaggcactggaccaatacaagttgcgacaggcaagcatccactccaaccatgtggccaggactgatgaggccatgcctggtcgtttccaggagctggacagcaggttagcatcaggaggacccagtgaggggatttcatctgagccagtcagtgctgccaccacccagaccctggaaggggactcatcagaagtgggagaccagatcaacagcaagagagctaagcagatggcagagaaaagccctccagaagcatctgccaaagcccagccaattaaaggagccagaagagctccggattcttcatcggaatttgggaaggtgactcgaatgtgttttgctgtgttcctctgctttgccctgagctacatccccttcttgctgctcaacattctggatgccagagtccaggctccccgggtggtccacatgcttgctgccaacctcacctggctcaatggttgcatcaaccctgtgctctatgcagccatgaaccgccaattccgccaagcatatggctccattttaaaaagagggccccggagtttccataggctccattagaactgtgaccctagtcaccagaattcaggactgtctcctccaggaccaaagtggccaggtaataggagaataggtgaaataacacatgtgggcattttcacaacaatctctccccagcctcccaaatcaagtctctccatcacttgatcaatgtttcagccctagactgcccaaggagtattattaattattaataaatgaattctgtgcttttaa

SEQ ID NO: 8794 - DNA, 2041 bp, Homo sapiens
  ENST00000551809
cctgcttgaagcctaactgtccaccagaaaggactgctctttgggtgagttgaacttcttccattatagaaagaattgaaggctgagaaactcaggtaagcacttttgttgtgggtatacttttaccttcttggtctcctcatctcccaggtggtaacaaacagaaatgactaaagcctatatgtgtgtgtagtggaaaggagcagagggaactgaatacagagaggatcctgaatacacgatgctgaatagagagaggggactcctgggggtctttggggatggggaaggaattaaaaaagttggagggcactgggtttactgagagcagcgggatggatatagaagaggactgaggtttggagcagaataagactaagatatttaggcaagagatatttagataaaaacttggggaaatatttgagaatgggaaaggactaagagaacctaaggagagagttagggatcttgagatgaagaggcctgggaatggttcaggaggatactgaattaaggtgaggtccaggaacagtttagatgtccagggtcccagaactgttcaagagatctaagttgaatgctaggttctgattccctcttcctcttccaccctctgcctctttagcctctatcatgtggaacagctctgacgccaacttctcctgctaccatgagtctgtgctgggctatcgttatgttgcagttagctggggggtggtggtggctgtgacaggcaccgtgggcaatgtgctcaccctactggccttggccatccagcccaagctccgtacccgattcaacctgctcatagccaacctcacactggctgatctcctctactgcacgctccttcagcccttctctgtggacacctacctccacctgcactggcgcaccggtgccaccttctgcagggtatttgggctcctcctttttgcctccaattctgtctccatcctgaccctctgcctcatcgcactgggacgctacctcctcattgcccaccctaagctttttccccaagttttcagtgccaaggggatagtgctggcactggtgagcacctgggttgtgggcgtggccagctttgctcccctctggcctatttatatcctggtacctgtagtctgcacctgcagctttgaccgcatccgaggccggccttacaccaccatcctcatgggcatctactttgtgcttgggctcagcagtgttggcatcttctattgcctcatccaccgccaggtcaaacgagcagcacaggcactggaccaatacaagttgcgacaggcaagcatccactccaaccatgtggccaggactgatgaggccatgcctggtcgtttccaggagctggacagcaggttagcatcaggaggacccagtgaggggatttcatctgagccagtcagtgctgccaccacccagaccctggaaggggactcatcagaagtgggagaccagatcaacagcaagagagctaagcagatggcagagaaaagccctccagaagcatctgccaaagcccagccaattaaaggagccagaagagctccggattcttcatcggaatttgggaaggtgactcgaatgtgttttgctgtgttcctctgctttgccctgagctacatccccttcttgctgctcaacattctggatgccagagtccaggctccccgggtggtccacatgcttgctgccaacctcacctggctcaatggttgcatcaaccctgtgctctatgcagccatgaaccgccaattccgccaagcatatggctccattttaaaaagagggccccggagtttccataggctccattagaactgtgaccctagtcaccagaattcaggactgtctcctccaggaccaaagtggccaggtaataggagaataggtgaaataacacatgtgggcattttcacaacaatctctccccagcctcccaaatcaagtctctccatcacttgatcaatgtttcagccctagactgcccaaggagtattattaattattaataaatgaattctgtgctttt

SEQ ID NO: 8795 - DNA, 3720 bp, Homo sapiens
  ENST00000332262
agcagcgacagaaatatggtagtggtcgccacgttagggtccgtgggggcctcctgaggcagcctggtgccaacccgcacgcccaggctggggctcatcctggccctgcccacctcggggtcggaactacggtgggcctgggatgggggcgtcaagcactttcgcgccgtatccctccgccccccttcccgacaccctcgcggcgagcggttcttgccgcatcctgcgcagcccctgcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggca

SEQ ID NO: 8796 - DNA, 581 bp, Homo sapiens
  ENST00000483720
tgccgcatcctgcgcagcccctgcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggtctggcgtattctgacaggacacagtgagcgtctgtagaggagaggcttgaaataaaggagcacgaatattgcctggatttctggaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactgga

SEQ ID NO: 8797 - DNA, 659 bp, Homo sapiens
  ENST00000486814
cgcgtctttcccgttcggatcgcggggaaagcagtggctccaagtgagccagaggagagctgaggagaggagggggaggccgacgacctgggccctgggcctctgaaggctccaggttgatgtcaaagtcttgtgtctgtgcggtaggtctggcgtattctgacaggacacagtgagcgtctgtagaggagaggcttgaaataaaggagcacgaatattgcctggatttctggaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggt

SEQ ID NO: 8798 - DNA, 3935 bp, Homo sapiens
  ENST00000543253
agcagcgacagaaatatggtagtggtcgccacgttagggtccgtgggggcctcctgaggcagcctggtgccaacccgcacgcccaggctggggctcatcctggccctgcccacctcggggtcggaactacggtgggcctgggatgggggcgtcaagcactttcgcgccgtatccctccgccccccttcccgacaccctcgcggcgagcggttcttgccgcatcctgcgcagcccctgcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggtctggcgtattctgacaggacacagtgagcgtctgtagaggagaggcttgaaataaaggagcacgaatattgcctggatttctggaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaaggaggcagccggtccagagagactttctcaaagcccagctgtcccacctagcattcaacatcagtcgcactgcatacgtctcatacaattggaagagactcaaagcctcatttcattctctctccctagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggc

SEQ ID NO: 8799 - DNA, 3847 bp, Homo sapiens
  ENST00000535209
agcagcgacagaaatatggtagtggtcgccacgttagggtccgtgggggcctcctgaggcagcctggtgccaacccgcacgcccaggctggggctcatcctggccctgcccacctcggggtcggaactacggtgggcctgggatgggggcgtcaagcactttcgcgccgtatccctccgccccccttcccgacaccctcgcggcgagcggttcttgccgcatcctgcgcagcccctgcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaaggaggcagccggtccagagagactttctcaaagcccagctgtcccacctagcattcaacatcagtcgcactgcatacgtctcatacaattggaagagactcaaagcctcatttcattctctctccctagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggc

SEQ ID NO: 8800 - DNA, 2317 bp, Homo sapiens
  ENST00000482723
agacgtccgctgtgccgtcctcacagcaaggcctgctccgaggccccggggtgcgtcagcagccctcctcaaacaccctgggagtgcccagcagggcggaacacaccgggaaaccaacaccccaaaggcacaaggaagtatccctggagctaaaaatagttctggaaacttgccagggggccacaggctgggacgtgcgttaaggctccctggccaggctctgggttggtgtagtggggaaggggcgcccaggtcggccctgggaggacatgaacaggcttaggccgagggctctcagatgtatttacctctgtgcctggcagctggcccgtggtgacaggcagagctggaggctggccatcttggaaggcggccgaaggcccatgtgtcctcttggcctctggccccggagggcggatggggatgtggaagttgctgacagagcattttctgagctgttgggtcaggggctggggtgtctacagtgcagggaagctcagcagtgttgttcactcccatgcatctgtacaaaggggtgctaggcttgggagggggcccccgtgttcacaacctcacccccaagttggccactcctgggttagagactatgccagggttggcctgccccctttacctcttccctgcccccagagagccttgcttggtttgtgggaggtggggaagggagctgagagccctgggatcttcaaactgttcctgcttttccttgtagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtaagcgaactgacccagagaggccaggccaacaccaaccaggttttcctaagactctgacgtccagcagcctctctccgtggcccaccctgggctcagtccccacaaagtaaaacgagatggtagaagccctcttcccgggactgcacggcatcctgatcctcattcctctgtacccaggctggaccgggcccagcacctttcccatccttgtcattggagctgggaggggccggaggccaccaacctgaagcagtggaccgagtgggcccccgtgaagccctgagtgtgtgactggagcgcctagggccacctccctttcctgcccagcccatcttcctggtccccaggtggctgcagctacaaggagctgtccgcgggcccccaggctgcctccaactcccctcttgacacgcccccctccccccaaatcatagtccctgtgtccccaagctgtggttcagattgccttcttcccctctgtgaacaacaggcctcagtgccccgtcttgactctggaccttcctggccctgccatcttggtgtctggcactggcttgtcccaccctctgcctagatggatctcctccatgagtctttggagccaagccagggcagaagttggcccttgcccttctcaccagggcctcctgccaccacctggactgtggaaggccactgagatgggggcagagctcagcccgaggcttgggcacactgcttctctccacggcctgtgggtcctggatctgagcccttggggtgtttcactcaagagccactgagccgtccccatcttccacaaagcagtttccacaagcaagccagggccagccctgcctgcactctgcccgcagtgcccctcaacgtctgggatgaggatgagcctgctgagatgagggcagctctctccatccagcagtacctcatggagtgctcactaaggagttaggaatggcaggccacgctggcatctggggttcaaggtggctcctgtggcaggaacaggtgtccatgaccctgattacctggatctcacaggttctgggaatgcaataggggcctgctgtggctattccaacatctctggtcagggcctggaagtaccttaggacacatggggttggggtcaggactgcattctcagggaccagtggagagccctggaccagatgaactggagtctaggcctctctcgtgactgggacttgtgggacgtgggaggcctgtgagatccaggactaaagattatgctgtttcctaatgggcagatatgtaagtaggtaagtgggatcctcaggtaagcgggatccagaactaaagactgtgctatttcctg

SEQ ID NO: 8801 - DNA, 393 bp, Homo sapiens
  ENST00000582873
ccggagccagacgtccgctgtgccgtcctcacagcaaggcctgctccgaggccccgggctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgg

SEQ ID NO: 8802 - DNA, 1273 bp, Homo sapiens
  ENST00000342648
agagccaacgtgtcccggagcgcagaggcccagggggtcgcgctaaacactgtacctcggggaacaaaaccgtgaaggctaattaggacaagtcggagcagggaacggggacgccgggaggggagagcgcgctccgagttgggcagaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggcccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaa

SEQ ID NO: 8803 - DNA, 1592 bp, Homo sapiens
  ENST00000481232
agaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgtgtctcacgggagggccaggacgaaggtgacaaaggctaggtgtcccccacggagacgcgccaaggtagccccgcgcgtgtccgtaggcgcgctctctggaagacgcggtggggggtgcgcagggctgcaccctcacaccaattgccccggcgaaggccgagcccagaaagtgagtgcgcgtgagtgtgcgcgcgcccgcatgcgggggcgtggcagtcaacagcaacaacccacacgccggcagggccagaaactcccatctccctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggcccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaa

SEQ ID NO: 8804 - DNA, 550 bp, Homo sapiens
  ENST00000582444
ctgccggggacagctgggactggacaccacccagaagccagctggctggccctgccctgccctgctggaggcaccatctctgggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggccc

SEQ ID NO: 8805 - DNA, 584 bp, Homo sapiens
  ENST00000582473
agcctggaggtgagtcggggcggggagggccgggcaggctttgttcctgtgtaaacggagcgcacgtacctggagcgcggcgggcgcccgattagcgccctgaatggaggtgatgtaacggtgatgcaggctccagcccaccctcgccgaaagcaaggagccctgcctggggacaggcccgcgcgagagcgagcaacccagcgcgcctggctcagcctcggtcccagggagaggcaggccctgcgtcccggcccgggccccgccatcccagccaggaccgggcctggcccagcgccccgcgccgcgtccctcccacccccgcccgccccccgcctggggctggagttggccccaaacgctgcgctggagcggggccggcggcgagtcccagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctgga

SEQ ID NO: 8806 - DNA, 2224 bp, Homo sapiens
  ENST00000577663
tgtaccactgcactccagcctggacaacagagtgagactctgtctccaaaaataaataaataagaaaaaaaaaaaaaagtgcagatggggcggggccagagctgggatggagctgactgttagcatccgttcagggcgtcggcaccatgggggcactatccagcgcagatctgcaagcccagcattcagcactccctcccccagccccagctgttgccagctgcatggggccagctgtgttgggtggggactgtgtagggtccagctatgagttggtggagtctgcgtggggactgtgtagggtccagctatgagttggtgaggcttaacaagcagtgcaggtgattccaatgcacactcatctgtggttttggaccacagatgtagatgttccagggaccacatggacaggggccattgcagacaggcctgaggacctcctgggcctgattgacttgaaggctagtttggggtctgggagctacagagatttggtggcagctctttcccatagggctaagacagatggggccaggaatacacctttcctccagcataggagccggaacaggtacctcaggaccctcttcaccccacagctggtgtctctcacccacatgggagcaagacccagcgccaggcagagaattcaggtttcaagactccaaatcagggctggttgcagtggctcatgcctttaatcccagtgctctgggagactgacatgggagaactgcttgaggccgagggttcgagagcagccctggcaacgtagtgagaccccccccccccgcccaccatctctacaaaaaaaaaaaaaagactccaaatcagaccggccagactagatgcctagagagatgtgtgggcacacccagagccatgtcctccgccagggaagccagcaactgtgatgctgggggtatggtagtgacaggcggtcgactcggggtaatattcttggaggagccgggcatggtggctcacacctataatcccggcactttgggaagccgaggcgggtggatcacgaggtcaggagattgagaccatcctggctaacatgatgaaacaccgtctctaataaaaatacaaaaaattagccgggcacggtggcgggctcctgtagtcccagctactcgggaggctgaggcaggagaatggcgtgaacccgggaggcagagtttgcagttggccgagatcacgccactgcactccagcctgggcgacagagcgagactccgtctcaaaaaaaaaaaaaaagattcttggaggaagggggcctgggagctatgtcagacaggtagtagcagctctgtgtggctgactctccactggccctagcatttccctaaacaattggaagtaggagggtcttgagaaggggatccccctctgtgaagccccagcaccatccaaggtcagcaggggcctcgttcccatgcccagaggcagggtgagataaggggctcaggtctggctgtcccaggctgctcctggggcccagccagagggggcagaggagccgaggggggagttgggggggatctggcagtcccagccctgcaggaagtgtttgtgcatccgccccggcggaacctggctcccaatccccgactgtgagaccgcctgttcttccttccagtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggcccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttatt

SEQ ID NO: 8807 - DNA, 1554 bp, Homo sapiens
  ENST00000581590
caacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggatgacgaccagagcagctctctggagaggtgccctgtagtcagtcccacagctctctggtgctacccccgtccccagcagcctgtgcctttgtcactggcatacttttccagagctaaattgggcgagcaatccctgcagagtaggattgcagctctgactgtggcccccgacctctctgtgttgcctgtcgaagtccatgaacagaatgttatttccctccagtggaagggaagcagggagctctgtggacctcacgctgcccttggtctagcttagcggccccaagatcccttagtgaatcaaggcgctgtgttgctttcctatgtgataatttcaaaggagtccccggcagggcctgatacccagaggctgcagtctccagtggacgtgggtgtgtgtatagcctgagtcctctgggggtctgcgcgtgaggctcagggagggatgggatcctaaaagatgcaggcctgcctgtattcaggagtacccactggccctgcttactcccgcccgggccaagtggagaagaagttagatgagttcttaggaggagagaggcagcttctttgaggtggtcgagtggcatcacaaacaagcgttgaatggaaaaagactagaagaggcagagcctgtcacaggttcaccatcatccagccaacactatgggaaatctcacacccaccactgtcaaaccgaggactttggacttaataactgctcagaattaaacgaccttaccttccatgggtgagggcttactgcca

SEQ ID NO: 8808 - DNA, 1419 bp, Homo sapiens
  ENST00000392629
ggggaacctccctgaagagtgccctggtcacagcacccttgaagacagccattggccatggggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactga

SEQ ID NO: 8809 - DNA, 1529 bp, Homo sapiens
  ENST00000392628
aaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggctcagtccccacaaagtaaaacgagatggtagaagccctcttcccgggactgcacggcatcctgatcctcattcctctgtacccaggctggaccgggcccagcacctttcccatccttgtcattggagctgggaggggccggaggccaccaacctgaagcagtggaccgagtgg

SEQ ID NO: 8810 - DNA, 2988 bp, Homo sapiens
  ENST00000392627
aaacactccgggccgcccgccccgccaccagctggctccgaccggcgcaccgctggcgatcccccaggcaattcggcgtcatgagaaccggcaccccgagactcggcgccctgccctccctccgcgtctccagggccctggccaggcccaacaacctctccctcctctgtgcgcctcagcccctacgggcctctggcgcgggctaactaggcctcgctgcgggcccccaggactgcgcaccccaccccccgcgaggccagcagccccgggggaaggcggccggaaaatctcttgtttatcgggctggataagtaccagcctggattcgcttcccaatttctgcggtccagcttcagcagattcctggggccggaggggaaagggtggcaacccacagatccaccccggaacagggagtggggggtggggctggtgggaacctgacctcctggaaaggacggactcggagtcagagccaacgtgtcccggagcgcagaggcccagggggtcgcgctaaacactgtacctcggggaacaaaaccgtgaaggctaattaggacaagtcggagcagggaacggggacgccgggaggggagagcgcgctccgagttgggcagaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgtgtctcacgggagggccaggacgaaggtgacaaaggctaggtgtcccccacggagacgcgccaaggtagccccgcgcgtgtccgtaggcgcgctctctggaagacgcggtggggggtgcgcagggctgcaccctcacaccaattgccccggcgaaggccgagcccagaaagtgagtgcgcgtgagtgtgcgcgcgcccgcatgcgggggcgtggcagtcaacagcaacaacccacacgccggcagggccagaaactcccatctccctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggcccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaa

SEQ ID NO: 8811 - DNA, 7433 bp, Homo sapiens
  ENST00000406462
aaagaagataactcattcaaggtcaatcagcaatgtctgaagaagaaagaagaggacaggaaagaaacttcagtctgagggttgaggacacgtcccggagcagaggaggaccaagctcccaagccccctgtcaccttgacacgcagacggttccccaggactgcgaagaggggggcaaccagcgccccgccccgccccgctgcgccgcccgccattggccggtccgaaagacgcggggcgttgtcggtttgaatgagagcgcctggagccggggcgcaggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctccatgaaaatctgtttttttaggccaaagtcagtataaaagaaactctacttcttgggctgggcatggtggctcattcctgtaatcccagcacattgggaggctgaggcaggaggatcgcttgaggctaggagttcaagaccaacctgggcaacatagacccccgtgtctatgaaaaataaatcagcagccaggcgcagtggctcacacctgtaatcccagcactttgggaggccgaagcgggcggatcacttgaggtcgggagtttgagaccagcctggccaacatagtgaaaccctgtctctactaaaaatacaaaaattagctgggcatggtggcatgcgcctgtagtttcagctacttgggaggctgaggcaggagaatcacttgaacccctgggaggcagagattgcagtgagctgagaccaagccactggactccagcctgagtgacagagcaagactctgtctcaaaaaaaaaaaaaacagcaagcatgctggcacacacctgtagtcccaactgcttaagaggctgaggcaggaggaccacttgagcccaggaggtggaggctgcactgagctatgatcgtgccactgcactccagcctgggtgacagagcaagaccctgtctctagaaaacaagtatcttttgtgtgttttgggctgtttaaaaaaattatttaaaatggtctcttctgttccataatactgctgtaaaacaaacttttctaagttctaatataaaaacaaaaaacaaaacccatgtggttaggtcaagaacctaggacacataaacaaacagaaaacagatgaaaactcacaaaaattaaatatgaaagaaagatgtcagctagaaccttagttgtcattaagctttgtcttccttatcccagatattgaaggcagtttacaaggggatgataacaaagtaactaactaactgtagcaaaagacaagtatgggacagactgggacctggagtaacactggatcacagactgcaaaggcccacgcttggaacaagttgccaacttgtttcactctgcttgcttcagactgtgcacagctgggatgggatctggggatgtggacccctattctttcaaaaagtcattcaggtgatttggatgggcaaatagaactatttctctaatggccaatgttttttaagagtcataacctggaattaattacattaagtgctcagctaaaaaaaaaaaaaaagttctaaattacaacctggattacattatgtttcatgtatactataaggtatgatgtcctggatagcattttaaaaactcaggtaagtttcatggggttcttataagaaaattcagttaagacaatataccaaaccacaacgtaaaaagtttgtgtatacaaactttttgtattatttgtacacaaagtacaaatttgtatttgtacacaaagtacaaactttgtgtattattttgtgtatacaatagttcttacagcctgtaaacattcaacattattccatttaaacattgtttttaacagctgtctaccctgttctgattttcctaaaagcttcacactatataggctgggcacaatggctcatgcctgtaatcccagcactttgggaggccgacaagggcgggtcacttgaggtcaggagttcgagaccagcctgaccaacatggtgaaaccccatctctactaaaaaatacaaaaattagccaggcatggtgatgcacatctgtaatcctagctactcgggagactgaggcaggagaatctcttgaacctgggaggtggaggttgcagtgagccgagattgtaccacctcactccagcctgggtgacagagcaaaactctcaaaaaaaagtaaaatttcaaaaaagcttcacaatataaaccttaattttaatgacatattggctagtcaataaacaagtcttatctcatctcatctcttttctgataacaaacacccgatgtgttcaatttgctttcatatttaagtctttcctgaattgctgtcatcattcaacaacagttgcatgtcgccttgctagctgtcaaagtagacttcatccccaaatggatatctgtaatgaaagaatacaaaggtgaaattttatttaaaaattttttaaaagaatttggttttggattaaaaggcatgcaagcagcattaattccactcacagttacagtctatcacctggggcattcactacttttcagagtcagatcacagttcaaaagacagctctcaccttgggggcatattccccaagtcagtgtgaacatgtcttgtcccaagaggacactttatacgcatggatgttcacaaatttattctaaactgcaggtgtctgtcaggattcatttgttaaacatgtcctctgtgttaaaaatcctaaaatccttttgcatttcttagaaaaaatcacgtttctgatgaaattctaaagatgtttgcaatattaaactagaatatattaacatgtataattttgagacaaggtcttgctctgtcacccaggctggagtacagtggctcgatcataactcactgccacctcacgatcctcttgcctcagccctccaagtagctgggactacaggcgtgtaccaccatgcctggctagttttatttttagtacatagccttgaacaactgagcttaagcgatcatcctccctcaaccttccaaagtgctaggactgtaggcatgagccactgcacctggcctaaaattacattgttacaggcacgtaagtaacacttcctggatccaaaaatgtgtattctgcatttcaacaactgaacttaagcgatcatcctccctcaaccttccaaagtgctaggactgtaggcatgagccactgcacctggcctaaaattacattgttacaggcacgtaagtaacacttcctggatccaaaaatgtgtattctgcatttcaacaactgaacttaagcgatcatcctccctcaaccttccaaagtgctaggactgtaggcatgagccactgcacctggcctaaaattacattgttacaggcacgtaagtaacacttcctggatccaaaaatgtgtattctgcatttcatattaaaataaaaaagcaagtgcttgggatacaaatatctgcatgaaaatttaaagactttattcctgactggtatcacttttagtaagcagttgaacataacttgtagtgtgaatatggttaaaacaaaggacacctgatgtctgtgaagtctgctaaggacaggtacaaaatttatgcattgctttttaaaaagtttaaaatgaggaatgcttttgataatcagaaagactaatgtaaagtgctgactgatgtcctgtctgcagttaaggaagacacccaactctcttcttcctcatcatggtattctctatgtatagatctctaaaaatgcaaacttcctatggacaagacaatatgatttgctataatatgaattaagatatggtaatatctaatagtctccactgctaggattctgagtaacacaaaaaataggttttataaaaagcccatgcacttcaattggtgggggaaaagaataaagtcattttcagtcgactgactctgtaaaacagattaccaatataacaagctatgttatctaaattgccctggcagtcttcagttttctctaagtaaacaaagtaaaaggaacaataaggatgcaggcgtagtaatagctgtggaaaagatgaaactacagccacagtgacctgtgggcagcctgcgtagagataagctgaggtgtcagtcagactgatcctggtaacgatactccatggctgcatgaagatgctggaggcatcaagtgggtggccttaactctagtggattcactaggcaatgtaaattggttagtgggttcccgtaagtgcctgtaacaataaaatttctttttcaatgtccccaattcaaactggcctccttaactatccagaatcagtgatgcctgtcatctgttcatcttaaaataaacacttcttactttatgggatgtaaatatcaaagagaagatgaaatgaaaagcttttacatatataacgtgtttgttaattctaattgtcagtaaaaatgtgaatgttgaagttgaaa

SEQ ID NO: 8812 - DNA, 904 bp, Homo sapiens
  ENST00000435987
aggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacc

SEQ ID NO: 8813 - DNA, 992 bp, Homo sapiens
  ENST00000435475
aggcgtttgaggggctctcggagggaggtgacagggaggggtgcgtgtgcgtgcgtgtggggcttctgtgtccagaggtctgggggtgacgtcctttgttttgggcaggaggcgggctgggggcttgcgggacctgtgggcgctgcggggacgcggcgtcgatgctcaagaaaccagaaactcggcttgaggagttgctgcttttttgtcggaaggtcttcaaatgagagtaaagcgttaagagcctcactcctgagtctttttttttttttaagataaaaactatactagagtccagcgacttcttaccactctgaatgtgagtaacaaattgtgaatcaaagcccgaatccccgtggaattcattccgaggctgattgcaatcacttggagtcgggcgcgtcctacctaaaccaggcagtttatggcaaatacctgccttgaccgtgcttaaattagtgaacttttgggcaccaactggtcgatttaccatagaaattggtagttgctgcaaaaagaaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttg

SEQ ID NO: 8814 - DNA, 571 bp, Homo sapiens
  ENST00000446797
gcggcgtcgatgctcaagaaaccagaaactcggcttgaggagttgctgcttttttgtcggaaggtcttcaaatgagagtaaagcgttaagagcctcactcctgagtctttttttttttttaagataaaaactatactagagtccagcgacttcttaccactctgaataaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaa

SEQ ID NO: 8815 - DNA, 731 bp, Homo sapiens
  ENST00000441735
atatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaagtatgtctgtatatttttttcgttctgcatacagctcagataccactgaaaacattggtagtgttataattctcattcaggaagggcttattttgtattagagagttattattgtccatcattcagtaaaaaattattgaacaccga

SEQ ID NO: 8816 - DNA, 3032 bp, Homo sapiens
  ENST00000264126
aggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctcc

SEQ ID NO: 8817 - DNA, 1134 bp, Homo sapiens
  ENST00000553522
gctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcagaactgctcagggtagactggagacaaaagcaacagctcagaagtgctaaatcttgaagagcagccaaagcatgggcaacaaagtgagaccccatctctacaaaaaaaaaaaaaaattagccgggcatggtggcctgtgtctgtagtctcagctactaaagaggctgaagcaggaggaatgcttgagcccagaagttcaaggctgcagagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaacggcca

SEQ ID NO: 8818 - DNA, 990 bp, Homo sapiens
  ENST00000389614
cttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaa

SEQ ID NO: 8819 - DNA, 476 bp, Homo sapiens
  ENST00000557049
ttcattgccaagtccttctatgacctcagtgccatcagcctggatggggagaaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgcctt

SEQ ID NO: 8820 - DNA, 778 bp, Homo sapiens
  ENST00000557323
ggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcaggagagacagaagtagcaaaccctctttcgagatgtccctccagccccagaagtacctccagcctcacaccatctcttcagcctagcaagttgctggagggagtctataacctaccaggagccagccagccatttgtatcaagaaatagaaatctgccagggtacagtggctcacacctataatcccagcgctttgggaggctaaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcc

SEQ ID NO: 8821 - DNA, 1084 bp, Homo sapiens
  ENST00000612794
cttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctcggcacaaccacccgggacttcacccagctcaacgagctgcaatgccgctttcccaggcgcctggtggtccttggcttcccttgcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaacggcc

SEQ ID NO: 8822 - DNA, 2196 bp, Homo sapiens
  ENST00000513040
tctcacacatgtgggtttcaagtgcggctggtgccatccctctgagcagacgctgaaagagaaaacttctgagatagcacttgtgagcgaaaagcacaccaactggctcaaagagctgtggttgggcagatctggtgtaaatacaaagttccttcccgacatttcccagagtttcttgaagatcacctggcctctagaagatgacaaggagacagcaagtcctacaagcaaaaaggagcattcagcaaacattccaagcacagcttatgccctggaagagtatgttccacgggagagaagtgaagccagtgggtccggacctggaactctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgta

SEQ ID NO: 8823 - DNA, 994 bp, Homo sapiens
  ENST00000506445
acatgaagaaagagcttcctgcaattcaaggactgtacaaagctgaaacgcagagattttcatattatttgggagactcagaaatgagcttttaaggttgttccttgacttgcgggtcaataagcgcacaatggtgaagaaaaggctgccttctagtgacacggtgttccggtttgagactccgggcagcccaaggaaggccaacgtggaggcctcacgcagctccacagacagccccagctcggtgttcctcagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaa

SEQ ID NO: 8824 - DNA, 3175 bp, Homo sapiens
  ENST00000285689
atctagagccggctgccctctaaaaatccccctgttacagtcgggatagaaaacaaaaagcttaatttaccaggaggctaaacagattgtgccttcttaggcaaatgttccacctgcttggccaattagcttcctctcccgaaagactcgttcaacaggtttcctttttctcttctctgcctcctgggttggggaaagaggctgtcacttcgcttcgaccctccccttccctccctctcggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtcaaaaaaaaaagaaaaaa

SEQ ID NO: 8825 - DNA, 3109 bp, Homo sapiens
  ENST00000515200
atctagagccggctgccctctaaaaatccccctgttacagtcgggatagaaaacaaaaagcttaatttaccaggaggctaaacagattgtgccttcttaggcaaatgttccacctgcttggccaattagcttcctctcccgaaagactcgttcaacaggtttcctttttctcttctctgcctcctgggttggggaaagaggctgtcacttcgcttcgaccctccccttccctccctctcggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgcccatatcttctctccaaatctatgcttcattcaggaccaagatacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagtagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtcaaaaaaaaaagaaaaaa

SEQ ID NO: 8826 - DNA, 632 bp, Homo sapiens
  ENST00000514932
accaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactacctctctctgaatgtctaaagtgaagcggtttcctttcttcttcagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaa

SEQ ID NO: 8827 - DNA, 586 bp, Homo sapiens
  ENST00000513913
aatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccaacaatcttgagggccagcacagcctgaggacttgctgacacaaagtattgacgggccagaggaagtgggcagcctggatatcacatcaccccatgtctgctgctgctcaggtttctctcactgtctcttggctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaa

SEQ ID NO: 8828 - DNA, 546 bp, Homo sapiens
  ENST00000505720
atgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccaacaatcttgagggccagcacagcctgaggacttgctgacacaaagtattgacgggccagaggaagtgggcagcctggatatcacatcaccccatgtctgctgctgctcagctacctctctctgaatgtctaaagtgaagcggtttcctttcttcttcagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgac

SEQ ID NO: 8829 - DNA, 1532 bp, Homo sapiens
  ENST00000514099
atgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgagg

SEQ ID NO: 8830 - DNA, 1847 bp, Homo sapiens
  ENST00000513978
atgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgcccatatcttctctccaaatctatgcttcattcaggaccaagagtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttaca

SEQ ID NO: 8831 - DNA, 1363 bp, Homo sapiens
  ENST00000502348
attccatttcccctcccacgctgctcactcaaacacacgctagcctctgctgcttgaattctacatagtttcagtctgctgctgacaagacctccaagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaag

SEQ ID NO: 8832 - DNA, 570 bp, Homo sapiens
  ENST00000509882
atgcagagcagagctgggcagcacagacctgggagccagcaagtccacacagtctggcatttacaagtgaaacagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacaga

SEQ ID NO: 8833 - DNA, 574 bp, Homo sapiens
  ENST00000505441
agcagagctgggcagcacagacctgggagccagcaagtccacacagtctggcatttacaagtgaaacaggtgcgacctgcagctactgccgttgggacaccaggcaaggggttagaatggagattgggaaagggcctcgctgtcaaagttaactagcctatcagtgaggaatgaaaatcattccattctctagaaaaccatgttacttcatcgttttccttccagctacctctctctgaatgtctaaagtgaagcggtttcctttcttcttcagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaag

SEQ ID NO: 8834 - DNA, 1577 bp, Homo sapiens
  ENST00000511134
agagctgggcagcacagacctgggagccagcaagtccacacagtctggcatttacaagtgaaacagctacctctctctgaatgtctaaagtgaagcggtttcctttcttcttcagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagaccc

SEQ ID NO: 8835 - DNA, 604 bp, Homo sapiens
  ENST00000504859
tacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgaggtttgggaaattgttgtattttgactaaaatttaattcccctcaaaacatcctcaccccacccccttaaaaa

SEQ ID NO: 8836 - DNA, 679 bp, Homo sapiens
  ENST00000508523
agtggaaatctaggtcagagcagagaaggcggaccctcgggaattgttaaatacccttaaaaacaaaaacagagggagagagattttaaaggggatctagtgaatgtcaccagccttttcttaatgtccaggccttttcttctctgggcttgtttgaggcaccagtgacaggcttttggagccttcattttgccctacatgtatttattactcttaaattgggtttgaagattttgttgcttttatgggagaatgtttgctttattacaggaatggaataaaaatggaatgtttgagtgagaggaatgagaatatagatcaaagagaggtccatgttgtttgaaaatgcaaaagctgtatacagatacttttctgaactctcaactctcacttctcatccggcaatatctattcataattatcctgttttgtttttcagtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaa

SEQ ID NO: 8837 - DNA, 578 bp, Homo sapiens
  ENST00000512579
gagagattttaaaggggatctagtgaatgtcaccagccttttcttaatgtccaggccttttcttctctgggcttgtttgaggcaccagtgacaggcttttggagccttcattttgccctacattacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatat

SEQ ID NO: 8838 - DNA, 375 bp, Homo sapiens
  ENST00000503702
gcttgagaatggtgactgatcgaccagattgcttgggccatcggaatacctcatgtttccctttgaagaagttctcctgttatgttctggttgaaatcacctgtgtgtcttaatttctcaattcctttttggcaagaatatcaagcaagatagggtctcactctatcatcgcccaggctggagtacagtggcgcaatctcggctcactggaacctctacctcccaacctatcctctcgcctcagcctcccaagtagctgggactacaggtgcacaccaccacacccagctaattttttgtatttttagtagagacaggtttttccatgttgcccaggctggtgttgaactcctgggctcaaacaatccacctaca

SEQ ID NO: 8839 - DNA, 2977 bp, Homo sapiens
  ENST00000542322
ctgttacagtcgggatagaaaacaaaaagcttaatttaccaggaggctaaacagattgtgccttcttaggcaaatgttccacctgcttggccaattagcttcctctcccgaaagactcgttcaacaggtttcctttttctcttctctgcctcctgggttggggaaagaggctgtcacttcgcttcgaccctccccttccctccctctcggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgcccatatcttctctccaaatctatgcttcattcaggaccaagagtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaa

SEQ ID NO: 8840 - DNA, 2822 bp, Homo sapiens
  ENST00000544396
ctgttacagtcgggatagaaaacaaaaagcttaatttaccaggaggctaaacagattgtgccttcttaggcaaatgttccacctgcttggccaattagcttcctctcccgaaagactcgttcaacaggtttcctttttctcttctctgcctcctgggttggggaaagaggctgtcacttcgcttcgaccctccccttccctccctctcggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaa

SEQ ID NO: 8841 - DNA, 375 bp, Homo sapiens
  ENST00000447351
ggggagggcggatccaggtctggagtctttggattgaaaggttggagatgcctgtgggactcccaagggaacccgagcgtcatgttagggtgaagcagaggacctcagtgctgaacatgctaaggaggttggacaaaatcaggttcagaggtcacaagagagatgacttcctcgatctagcggagtctccaaatgcctcggacaccgaatgcagcgacgaaatccccctgaaggtaccgcggacctcgccccgggacagcgaggagctgagggaccctgctggtccagggaccctcatcatggccacaggagtccaggactttaaccggacagagtttgatcgactgaatgagatcaaaggtcacctggaaattg

SEQ ID NO: 8842 - DNA, 311 bp, Homo sapiens
  ENST00000431155
ccgccgcctccgcgctcgtggccgggacccgcggggccgcctcctcccggctccccggcgccgctgggctcccgggcgggcggcaggcgtagcgcggccgggcggccggcgaggggggcgccgcggcgggtggatgagagttggccccgatatccgctcaggggaacccgagcgtcatgttagggtgaagcagaggacctcagtgctgaacatgctaaggaggttggacaaaatcaggttcagaggtcacaagagagatgacttcctcgatctagcggagtctccaaatgcctcggacaccgaatgcagcg

SEQ ID NO: 8843 - DNA, 4484 bp, Homo sapiens
  ENST00000406902
ctccaggctccagggcagcagacaccaccctctccgtgcctgctggtgttgggcggcttggaggctatggttcctgggtcctcgtagcacatcctggttctgggccaggacctgaaggagccacagtgaaagagtgtttctggatgtatctgagacagacggagggaacccgagcgtcatgttagggtgaagcagaggacctcagtgctgaacatgctaaggaggttggacaaaatcaggttcagaggtcacaagagagatgacttcctcgatctagcggagtctccaaatgcctcggacaccgaatgcagcgacgaaatccccctgaaggtaccgcggacctcgccccgggacagcgaggagctgagggaccctgctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggtttggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaaccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagacgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaa

SEQ ID NO: 8844 - DNA, 193 bp, Homo sapiens
  ENST00000490378
gagatgacttcctcgatctagcggagtctccaaatgcctcggacaccgaatgcagcgacgaaatccccctgaaggctggtccagggaccctcatcatggccacaggagtccaggactttaaccggacagagtttgatcgactgaatgagatcaaaggtcacctggaaattgccttattggaaaaacatttctt

SEQ ID NO: 8845 - DNA, 669 bp, Homo sapiens
  ENST00000456069
ggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtggtgctgacaagggacctcagcttagaggggcagaggctgcctgctccaagcaaggatggccccagctgggacttgggctctcttgagctgagctgtccctcctgggtcggccaccacgt

SEQ ID NO: 8846 - DNA, 2834 bp, Homo sapiens
  ENST00000408031
gctgggtacttccagtggaaagtgtgacaggcgggccttctcccattagtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaaccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagacgaatgttaaattttttatgtctgaagcctgagtctattttggatctgtaaataatcattgccagtgtgacttttgttcaacaaaaggattgtactgtattaagaaccgatgaaaaaaa

SEQ ID NO: 8847 - DNA, 4315 bp, Homo sapiens
  ENST00000361034
cgtcatgttagggtgaagcagaggacctcagtgctgaacatgctaaggaggttggacaaaatcaggttcagaggtcacaagagagatgacttcctcgatctagcggagtctccaaatgcctcggacaccgaatgcagcgacgaaatccccctgaaggtaccgcggacctcgccccgggacagcgaggagctgagggaccctgctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggtttggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaaccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagacgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaaggctc

SEQ ID NO: 8848 - DNA, 4760 bp, Homo sapiens
  ENST00000402578
accgactctgtgaattgggtaccttcatgatacccattttataaatgagaaaactgaggtttttactatatgctggtcatcatgctgaggactttacttggattttctctcctgccaatgctacgcggtggggaccttcatgttctcccctttgcagatgagattatcaaagcagaaaaagaccatctctcctactgagtaacagaggaaaccagggcttgcagatattgaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttca

SEQ ID NO: 8849 - DNA, 5432 bp, Homo sapiens
  ENST00000403097
ggcagccgggcgccccgcggggctctccgcgctgcgttcccgacccctggggggaggtgtggagtccaagcggtgcattcttgaaccatcttgtcagacgccggcggctcgcgggctgtggcgggggctgcggtcaaggccgcgctcctgggggccgccgcctgggagggtgggcgcccaggcgtccctgcagccccgggtgctccgactgcgcggcggggccgcggcgcgcgcgcccgggcgtccgggcgtccgggacagtggtgccagacactcccaaatcccgagccggcccagcctcgtacggaggaccttttttttggttctgttggtgacccgttagccgccgctggggcctaacaccaagttgagggctcgcggattagccgcccgccagccgtggaaatgtgataagagcggtaccgtttgcagaaggaaatttctgatgcaactcttcgcctttgctgattgcctctccaaacgcctgcctgacgactgccttggagcatgtgcgttatggaaattaggctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggttctgaaaatattgtgcacagggcaggctgaggacacagccacgtgatacccactgtagagagagggagagagagacctcctatgcaagctgccggccctctgttccgtagtaaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttca

SEQ ID NO: 8850 - DNA, 2700 bp, Homo sapiens
  ENST00000406641
ctttccagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacagatattctggaggaaggtgtgaacgcaactttgcctcccagggaacaaacatcctccttctaagtggtagatgtgggtgagctgaccctgctggagtctgtcccctgggctaccctctgcttccccccattgtgagtggtccgtgaagcacagcgttgaccagacctaaacctgtttgctcccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttccca

SEQ ID NO: 8851 - DNA, 2050 bp, Homo sapiens
  ENST00000357271
aaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgttta

SEQ ID NO: 8852 - DNA, 2279 bp, Homo sapiens
  ENST00000407526
cagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgttta

SEQ ID NO: 8853 - DNA, 2627 bp, Homo sapiens
  ENST00000401949
cagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccagacttgggaggctgcattctgataattctcaggaggaagaatgtataggagagaccagggtttttaaggtgtgacctctgaaccacctacatcagagctgactgcctctcgctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggtgctgcagcgcagtaaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgttta

SEQ ID NO: 8854 - DNA, 2289 bp, Homo sapiens
  ENST00000402497
gaagcgagctgcggccgggcgggctcggcgctcggagacccggtggagcccaaagtttccgcgcagcccctgggtggcggcagcgccggcggcgcggggcgcccgggacagtcttgagcgccggcctcgccccgcggggacccgcgcccgccgccggccacgccgagtgtcgcccgcagccacgcggaggcggcggggagccgcgcgcggcaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaa

SEQ ID NO: 8855 - DNA, 624 bp, Homo sapiens
  ENST00000461886
tatgcaggcacaaaataatccttttcatcctatagtttccctgccctaaccctgtagtcaggcatatccccaaggagcccagcttttttccaatggagaatgacaattcagaattaccgtcttggtgcttgcctggtgtgctgttgcccctagaggccacttaaatgccaaagcactgcactgaagcattgtggctccaagcctgtgtgtgtgtgtgtgtgtgtgtgtgtgtgtgtgtaagagagtgtgtgtgtgtgattagttccagattttaaaatattttagcaatcaactattttcccttccccaggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtga

SEQ ID NO: 8856 - DNA, 1065 bp, Homo sapiens
  ENST00000473696
tgcatgttgtagtaaaaaaatgggctcatgtttctggagtatttttcgttgtgtgtagtgcaatacaggaactttaaagaacaccatgggacccatgtgaaatgccactagtgaagctggaagtgcgcccaagaacagagaaaagtcacgacatgacaagaaaaacttaaattgcttgatacatactagagattgaatggttgccctccacaccacacagataattcattgtgtcaacatgtagacttacagaatcgaatgcagtacagtcccataattgtattgtctcttatgattttcttaataacatttttttctctagcttccttataaaaatatggtgtagaatacatatacgaaatatatgttaattaactgtttatgttatcattaaggcttctggtcaacagtaggccactagtaggtaagttttgggggagtcaaaagctatactcggattttttatttcaaggggcgtcattgctcctaatccctgtgttgatcagggtcagcggcactcaggctcctggaggctggtacagggcatcactccctgttccgcactcaacattgccctttcctgctgtggcgtttgtcacatgccgggcctcggggctcccgggccggtgactaactgtggcttctcctctccagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcat

SEQ ID NO: 8857 - DNA, 575 bp, Homo sapiens
  ENST00000482397
atggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggagggtaaggccccggccctggccagcctggaggggcaccctcaaggtggtagccccaccacgtggtcttctcccagaggaacagctctatgcgggttggcaagaggggtgccatgttgggtggggtgagttctcagctgcaggaagcagttggcccttctaggccccttccatgttcccagcacccagcctttccccgctgtcccctgtcccctgggctttcatggaagggacaggagaggaacagagttctctgccctccgtggctcctatgcagaactgttctgctgatgaactggcagtggctgtctgtggagtgcacagagcccaggcctgagtggggccagcaggtgctcacatcaaggtctgctactaacagcctgga

SEQ ID NO: 8858 - DNA, 484 bp, Homo sapiens
  ENST00000428711
ctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcaggtactgggccacaatagatctctgctgaaatagactttctgaatagaaatcctcttggaactgaatggcagcattgtaaaaaacctaaagagatcgcatctttcaccatttataaccttggctcttaagccggaggggtggttggggggagggtttagagtaaccagaaattaaaagtttccttggaaaa

SEQ ID NO: 8859 - DNA, 733 bp, Homo sapiens
  ENST00000439044
cgagctgcggccgggcgggctcggcgctcggagacccggtggagcccaaagtttccgcgcagcccctgggtggcggcagcgccggcggcgcggggcgcccgggacagtcttgagcgccggcctcgccccgcggggacccgcgcccgccgccggccacgccgagtgtcgcccgcagccacgcggaggcggcggggagccgcgcgcggcaggtgctgcagcgcagtaaatgtaatttgaagaaggcagaaggaacccatggctttagccggctgcccagattcctttttgcaccatccgtactaccaggttctgaaaatattgtgcacagggcaggctgaggacacagccacgtgatacccactgtagagagagggagagagagacctcctatgcaagctgccggccctctgttccgtagtaaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcag

SEQ ID NO: 8860 - DNA, 381 bp, Homo sapiens
  ENST00000465602
aagctggggtcccatggagctgccctgctccatgcttgcatgccatttctctcagcgttggagcagagccctcaacagtgagcgtggtgctgcagcgcagtaaatgtaatttgaagaaggcagaaggaacccatggctttagccggctgcccagattcctttttgcaccatccgtactaccagaaaaatgcaaaataggaaataaaatgtgcttggctacaaacttccgtacacaatgttgaactgagcattagaaatgaaacaacttgcatgtgaattttatcgtcattgtgaaaattggaagacacttatataaactttggcattgtgtttagcacacaaaagaccctgttaaatgtgagccactgtttggatgagctg

SEQ ID NO: 8861 - DNA, 657 bp, Homo sapiens
  ENST00000483819
atgggtttggtcctgggattcctgttgtgctccaggaccgggcgctgctccgtcgtcctcccgctcctcaggagcgcccagtccctcggaggctgagtattgcagccgggcggcagccggctccgcggaggggcccccgggcacctgcgtggtgatggcgctgggagcccccgggcacgctcgggcggtggcgcggcatcccaccctcgcccggatggcgtccccagaggcggcgttggcccgcttttcgtgctagcgcgttcgcctggcgcgcggtggccccgaggccccgggtcggttttctgcgccgcaggcccctggccggggcggagccgtggaggaccagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacag

SEQ ID NO: 8862 - DNA, 544 bp, Homo sapiens
  ENST00000470992
gattatgacgtgctggcggccagggcctcgggtgctgcctggagtctcctgcgtgtctctgctcctttgatgtcagcatcggggtgtctgggagccagcttctgagtgttgtcaaggtagtcctggtggcttgagactggtgatgtgccgttgccaacaatggctgtgtaattctgagcagttgttcagcactcaagtgggatgagaatggcaaggagtgctctgggtggcttttgacaagggaccccgcctgtcattcactcaacaggtgtttgaggagccagtctgtctccgtcatctgttcctgccttacttagatggaaaataatgaaatctgtgtaggaagggaggaaattctctgaagaggacactttacctgctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcct

SEQ ID NO: 8863 - DNA, 540 bp, Homo sapiens
  ENST00000483157
acgcattccccctttggcctgggtgggaacaggggaggtggtgggcagggccagaagggcttactgggattttctttctctctgtcactccagagaaaggtggtaaagaacacttgtttcagtttgaggtgctcggcagccacgcgctgaaggacggtttttaattgtagggactgagaatggtgcatactaactgctgaggaacatggtgaatggagttatggtaattgcacgattggcatgaaggggtgagagaagttccagattggtcgattaaaatgtgtttgaggagccagtctgtctccgtcatctgttcctgccttacttagatggaaaataatgaaatctgtgtaggaagggaggtgtctttttctctagaaattctctgaagaggacactttacctgctgggaacactgaaccccaatgactcaataatttgcccagacatcagccgctaaggggtggcatctggagatgaaccaagactctctggtgcctggatttttagcaagcatgttcagcgggacctgtttcaaaa

SEQ ID NO: 8864 - DNA, 447 bp, Homo sapiens
  ENST00000492265
ctccgtcatctgttcctgccttacttagatggaaaataatgaaatctgtgtaggaagggaggaaattctctgaagaggacactttacctggctggacaggaagcacggcagcatctactcggcttctgaggcgtcctcaggaaacctacaatcaaggtggaaggcgacaggggaagcagacatgttttatgtggctggaggaagaggaagagaagtggggggaggtgccacacacttaaacaaccaggtctcttgagaactccatcacaacagcaccacgaggatggtgctaaaccattcatgaaggatccaccaccacagtccagtcaccttccaccaggctccacctccaacactgggggttacaatttgaaatgagatttggtagggacacagaaccaaaccatatcagacagttcttaaaaatctttttcaatttaacattta

SEQ ID NO: 8865 - DNA, 524 bp, Homo sapiens
  ENST00000467386
gggtgctgcctggagtctcctgcgtgtctctgctcctttgatgtcagcatcggggagaaaggtggtaaagaacacttgtttcagtttgaggtgctcggcagccacgcgctgaaggacggtttttaattgtagggtggggactgagaatggtgcatactaactgctgaggaacatggtgaatggagttatggtaattgcacgattggcatgaaggggtgagagaagttccagattggtcgattaaaatacttgggaggctgcattctgataattctcaggaggaagaatgtataggagagaccagggtttttaaggtgtgacctctgaaccacctacatcagagctgactgcctctcgtgtctgggagccagcttctgagtgttgtcaaggtgtttgaggagccagtctgtctccgtcatctgttcctgccttacttagatggaaaataatgaaatctgtgtaggaagggagggtgagtagagggatggcctgtgttgactgaacaataaaatagtgatgttaat

SEQ ID NO: 8866 - DNA, 599 bp, Homo sapiens
  ENST00000478162
agcatcgggggtgggagcagggcccacgcattccccctttggcctgggtgggaacaggggaggtggtgggcagggccagaagggcttactgggattttctttctctctgtcactccagagaaaggtggtaaagaacacttgtttcagtttgaggtgctcggcagccacgcgctgaaggacggtttttaattgtagggtggggtgtgagtgcagtgtggttcagtcccctccccatcttgtgctacctgccgttgtacctggacctgtgaatcagggataatagttactatcttgtaggactgagaatggtgcatactaactgctgaggaacatgacttgggaggctgcattctgataattctcaggaggaagaatgtataggagagaccagggtttttaaggtgtgacctctgaaccacctacatcagagctgactgcctctcgtgtctgggagccagcttctgagtgttgtcaaggtagtcctggtggcttgagactggtgatgtgccgttgccaacaatggctgtgtaattctgagcagttgttcagcactcaagtgggatgagaatggcaaggagtgctctgggtggcttttgaca

SEQ ID NO: 8867 - DNA, 578 bp, Homo sapiens
  ENST00000490051
tgtcagcatcgggggtgggagcagggcccacgcattccccctttggcctgggtgggaacaggggaggtggtgggcagggccagaagggcttactgggattttctttctctctgtcactccagagaaaggtggtaaagaacacttgtttcagtttgaggtgctcggcagccacgcgctgaaggacggtttttaattgtagggtggggtgtgagtgcagtgtggttcagtcccctccccatcttgtgctacctgccgttgtacctggacctgtgaatcagggataatagttactatcttgtaggactgagaatggtgcatactaactgctgaggaacatggtgaatggagttatggtaattgcacgattggcatgaaggggtgagagaagttccagattggtcgattaaaatacttgggaggctgcattctgataattctcaggaggaagaatgtataggagagaccagggtttttaaggtgtgacctctgaaccacctacatcagagctgactgcctctcgtgtctgggagccagcttctgagtgttgtcaaggtagtcctggtggcttgagactggtg

SEQ ID NO: 8868 - DNA, 4705 bp, Homo sapiens
  ENST00000398812
aaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttc

SEQ ID NO: 8869 - DNA, 5032 bp, Homo sapiens
  ENST00000335866
ggggaggtcgggaggaggcagagagggaagcgagctgcggccgggcgggctcggcgctcggagacccggtggagcccaaagtttccgcgcagcccctgggtggcggcagcgccggcggcgcggggcgcccgggacagtcttgagcgccggcctcgccccgcggggacccgcgcccgccgccggccacgccgagtgtcgcccgcagccacgcggaggcggcggggagccgcgcgcggcagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttc

SEQ ID NO: 8870 - DNA, 4785 bp, Homo sapiens
  ENST00000398810
cgcaactttgcctcccagggaacaaacatcctccttctaagtggtagatgtgggtgagctgaccctgctggagtctgtcccctgggctaccctctgcttccccccattgtgagtggtccgtgaagcacagcgttgaccagacctaaacctgtttgctcccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttc

SEQ ID NO: 8871 - DNA, 1983 bp, Homo sapiens
  ENST00000488342
cggcacctcgcctcccgccgcgcaaaccccttctccccacgcgccgagtctcccatgacgcccgagccccccggccggcgacaatgaccacttccctgcaagatgggcagagcgccgcgagcagggcggctgcccgggattcgccgctggccgcccaggtgtgtggcgctgcccaggggaggggcgacgcccacgacctggcgccggccccctggctgcacgcgcgagcgctcctgccccttccggacgggacccgcggctgtgctgcagacaggagaaaaaagaaagatcttgatgttccggaaatgccatctattccaaacccttttcctgagctatgctgttctccatttacatctgtgttgtcagcagacctatttcccaaagcaaattcaaggaaaaaacaggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaaggtgttaccttcaagatatgcattaacgataaacaatgtgctgtggccttctagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattaccatgtgaaaagaatgtatttcacctgcaagttacaaaaaaatagtttgtgcattgcaaataagcaaagacttggattgactttacattcatcatttaaaattcattagttaaaattaaaccttaggaaaaaaatgac

SEQ ID NO: 8872 - DNA, 2382 bp, Homo sapiens
  ENST00000263915
atgagggtcagggctgcgcggacccctatcccgcctgcggtcctcccggcaagcccagcgggagcgcccgctcggctgggtccccgcctccagcggcgccggggccgcccagaccctgggctcagcctcgcgccccggtgcccacctgaggaggcagcggtcccggcctcgcgtcccggatgggacggcgcgggagcaatgccagtggccccgagcgccccgggccacgcgcggggccggccagccgctctcgcgccctccccgccccctccgcgccttgcctcgccgcccgcggcccccacccaccggccgctcctcccctctccccaccctcctcctccgccccctcccctcccccgccgcctcgcagatagctcggccgcgcgtctcagccgccggggccccgagcgcaggcggcgaggccaccacacctgcagagcgctcgggctgcctagccggcacctcgcctcccgccgcgcaaaccccttctccccacgcgccgagtctcccatgacgcccgagccccccggccggcgacaatgaccacttccctgcaagatgggcagagcgccgcgagcagggcggctgcccgggattcgccgctggccgcccaggtgtgtggcgctgcccaggggaggggcgacgcccacgacctggcgccggccccctggctgcacgcgcgagcgctcctgccccttccggacgggacccgcggctgtgctgcagacaggagaaaaaagaaagatcttgatgttccggaaatgccatctattccaaacccttttcctgagctatgctgttctccatttacatctgtgttgtcagcagacctatttcccaaagcaaattcaaggaaaaaacaggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattaccatgtgaaaagaatgtatttcacctgcaagttacaaaaaaatagtttgtgcattgcaaataagcaaagacttggattgactttacattcatcatttaaaattcattagttaaaattaaaccttaggaaaaaaa

SEQ ID NO: 8873 - DNA, 406 bp, Homo sapiens
  ENST00000497306
agatgaggctcagcgattgattattcagcaaggacttgtggatgggtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattaccatgtgaaaagaatgtatttcacctgcaagttacaaaaaaatagtttgtgcattgcaaataagcaaagacttggattgactttacattcatcatttaaaattcattagttaaaattaaaccttagga

SEQ ID NO: 8874 - DNA, 1435 bp, Homo sapiens
  ENST00000446413
atagctcggccgcgcgtctcagccgccggggccccgagcgcaggcggcgaggccaccacacctgcagagcgctcgggctgcctagccggcacctcgcctcccgccgcgcaaaccccttctccccacgcgccgagtctcccatgacgcccgagccccccggccggcgacaatgaccacttccctgcaagatgggcagagcgccgcgagcagggcggctgcccgggattcgccgctggccgcccaggagaaaaaagaaagatcttgatgttccggaaatgccatctattccaaacccttttcctgagctatgctgttctccatttacatctgtgttgtcagcagacctatttcccaaagcaaattcaaggaaaaaacaggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatgg

SEQ ID NO: 8875 - DNA, 984 bp, Homo sapiens
  ENST00000469573
agttgtttcattgcactgagccctgagattcccaaggagtaaccataaaagatttcttttattttgtccatgacctacgagacaggatcattctaagaagagcaggcatgagtttgagtgcaagaagagtcactctgcctgcaataacgccaataattctacagaaaagggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagactacctgtggctccctggaatgatccccacctatctgtcatttctactagctgtacatgcagccattgtaccatcttcacacgtggtctgtttatgagatttagtgtttgtgagatcctgaggcctcatagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaaggtacaggcttaatattttgatagatgaataaagcaagcctcagccttttaggtaagcttgagtttcctttaattgcttt

SEQ ID NO: 8876 - DNA, 587 bp, Homo sapiens
  ENST00000424693
cttttctatatactttatataatatgagccttgtcacagagtggtacatgttcgccttagcacactttttattcctgacagcaattatattttacattctgttttatgtaaattacatcctatgttctcttactgtaggagaaaaaagaaagatcttgatgttccggaaatgccatctattccaaacccttttcctgagctatgctgttctccatttacatctgtgttgtcagcagacctatttcccaaagcaaattcaaggaaaaaacaggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactg

SEQ ID NO: 8877 - DNA, 612 bp, Homo sapiens
  ENST00000577695
aagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccattcgtgtgcaattcctggggcgcaggtagtaaaggtgtacagtgaggatg

SEQ ID NO: 8878 - DNA, 2243 bp, Homo sapiens
  ENST00000309156
aagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatac

SEQ ID NO: 8879 - DNA, 879 bp, Homo sapiens
  ENST00000485182
gcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtgagttgtccctcagaagggaagggagggatgcacgggttctgggtctgtgggagatacacagccgcttccatggaggcaggggatcttggttaggagtccctgagggtctagcaggtgcggaaagggaatgaatcaccctttgcctcccctcaagtcgtgtgcaattcctggggcgcaggtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactgg

SEQ ID NO: 8880 - DNA, 560 bp, Homo sapiens
  ENST00000583813
acacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacg

SEQ ID NO: 8881 - DNA, 570 bp, Homo sapiens
  ENST00000584853
cccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccagcgctccttgttccctccctgtacacctccctgcaggcagcagctgagaatgggaaggaagacctgattctctcctccgacttggctttcccgctgaaactagcccctccccgcacacccggggagagccgccctcactctctggctcgcccagtttaccccagtttgggtttccccaagtctctaagacagacgtctctgcgggctgcggggagatgtggggagggccccctccactttggagggcagtgaaggagagggatcctctaaattgtcgaggcttcatctctccagattgtatgcccttctcagcaacaccgcctccggccctccgatgggaaagtggaggccgggtgagacggggtccctcctggcttcagcatgaaatgggcaggaaggctggaggggtgt

SEQ ID NO: 8882 - DNA, 1146 bp, Homo sapiens
  ENST00000584819
gctggagggggacaggtagttaagggcctggcgtctccctccctgaagacgtggtcccagccgggtgtcctgacgctcggggttcaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtgagttgtccctcagaagggaagggagggatgcacgggttctgggtctgtgggagatacacagccgcttccatggaggcaggggatcttggttaggagtccctgagggtctagcaggtgcggaaagggaatgaatcaccctttgcctcccctcaagtcgtgtgcaattcctggggcgcaggtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacg

SEQ ID NO: 8883 - DNA, 2093 bp, Homo sapiens
  ENST00000394211
cgtctccctccctgaagacgtggtcccagccgggtgtcctgacgctcggggttcaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgataca

SEQ ID NO: 8884 - DNA, 630 bp, Homo sapiens
  ENST00000578702
gacgtggtcccagccgggtgtcctgacgctcggggttcaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatcc

SEQ ID NO: 8885 - DNA, 2197 bp, Homo sapiens
  ENST00000445327
tgcgggctgcggggagatgtggggagggccccctccactttggagggcagtgaaggagagggatcctctaaattgtcgaggcttcatctctccagattgtatgcccttctcagcaacaccgcctccggccctccgatgggaaagtggaggccgggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacacctatg

SEQ ID NO: 8886 - DNA, 1955 bp, Homo sapiens
  ENST00000394209
aggcaaaccccagccttggactggccctctctgatctctgaggccaggctctaatgtgatttgaatctacttctaaccccttccaagcactgccctcccgaattctctgctcctctccccaccccactgttggtctgtgatttcgaggcaggcgtggccccctgcagcctggaatgaagtcactggggctgtttggagaccggggctgtttggaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacagg

SEQ ID NO: 8887 - DNA, 584 bp, Homo sapiens
  ENST00000584053
agcctggaatgaagtcactggggctgtttggagaccggggctgtttggaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtgagttgtccctcagaagggaagggagggatgcacgggttctgggtctgtgggagatacacagccgcttccatggaggcaggggatcttggttaggagtccctgagggtctagcaggtgcggaaagggaatgaatcaccctttgcctcccctcaagtcgtgtgcaattcctggggcg

SEQ ID NO: 8888 - DNA, 1667 bp, Homo sapiens
  ENST00000394204
gacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggag

SEQ ID NO: 8889 - DNA, 554 bp, Homo sapiens
  ENST00000461756
tctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccagtgagtgcatgagggctgtctgggcgctgggatgccctgatcctcaacctggatgctggagccctgatccctgacacttgtctacccacagcactccctgttcccagaaaaaatggtctccagctgtctcgatgcacacactggtatatcccatgaagacctcatccaggtggggggaccccccatttcactgcagattcacgactccccagcattggccagtgcttctccacccttaagtcctgtgcctcccctctatgttgtagaaagagccaaatcacagtcctgtgtgactggggacagtcactttc

SEQ ID NO: 8890 - DNA, 467 bp, Homo sapiens
  ENST00000473071
gccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggtaaggtcttgagggtaccagccccagcccctccagtccctggtccttttagaagttgccccttctctgctggaacctctgagcccttctccccctgggccccccaggccagccacctccagtttaccatctctccctacatccttgcctagctcacctgcccagggaggtagcaggagaaaagatgatcttagtttaagtcctggctctacttctatttg

SEQ ID NO: 8891 - DNA, 438 bp, Homo sapiens
  ENST00000628795
ctcaggtgcgaggttccgtccatctttctgaacccacgcagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttcca

SEQ ID NO: 8892 - DNA, 8484 bp, Homo sapiens
  ENST00000381486
aaataaagttttttcaatggaaggcttgcagctcttgaggacctgccaaatggaagaaggacagagacctggagccctatggaaagttctgacaccatgtgtggaaggacatggcttttaacacgtgtggtgactggagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccatgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaattgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgacctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatgta

SEQ ID NO: 8893 - DNA, 2448 bp, Homo sapiens
  ENST00000263834
gatactagctctgaaacttttcccctggctggcttggctgcctctccctgccgggcaggggccaggaagcctgggtgtcaggcagacccgagccaggctctgcacagcagggcattacgcgccccacgcatcctcttccatccccaggcacagatcaaaggcgcagcccaggaggcgggagcccctgcacactttccacctctgctgggcttagcctcttggctggttggtctgtggagtgcctgaagtgaccagctttttgtaagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaagtatttgtaaatggtgctacccaaatggtagcccttggtccggcagaacctgcatcgccccggagcttatgagaggcgtgaattcatggacccatcctggaatcagaatcaggccccacttctgcatcagaagccctgggtggcaccagcaagtgtttggcaagcccttgagaagcagtgtctttgagaacgtgacctgtgccccaggcaccagctttactccccgagcccagcaggacatctgcatataacacacagccgaagtcagaaaatatatttttggtgactaaatggagtacctggagtacaagataacacacacacacacacacacacacacacacacacacacacacacacacgccacctttgggagctcagcagccccgagaggatttgatagcttcaccgcttcacctggttttacaaatgcggagactgaggtttagggcagttaagcttcttgcttagcatcatgtaggtaaagaatggtggaaagatatttgaacccgacctgggcaattccacctctgagggctgtcctcagaatgaatcttctgatgggctgggcacggtggctcacgcctgtaatcccagaactttgagaggccgaggcgggtagatcactttaggtcagaagttcaagatcagcctgggcaacatggtgaaaccttgtctctactaaaaatacaaaaattggccgggtgtggtggtgatgcgcacctgtcatcccagctactcgggaggctgaggtgggagaatcacttgaacttgggaggcagaggttgtggtgagccgagatcacgccactgcactccagcccggggacagagcaagacactgtctcaaaaaaaaaaaaagaa

SEQ ID NO: 8894 - DNA, 1315 bp, Homo sapiens
  ENST00000389825
gacacggggcggctgagcagcagtgtgttcatggagaaagaatcaaagcgcacatcttgtactttgatgcccataggaagggctctcctctggcccctctggctttgtttggagcagaaaacaacaaagtgagttcaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtagctctgcctgtcctggccgtcctggggatcctgctcttctttgggccaaggccagagggggcatgggagctgctgggctggggccgctgagcctcctggagtctgatgtggcttccatgagagtcaggccaggaccacaggtgcctcctgagtccgtgggtctgggcccaggccctggtgctctatgagtgacacttgggagttaccgtatgtgccaaggagcagtgagacacctgtggtaatggcgagtgacctgtcctatgggctgcacagctggaggatggtagaattttggagcaatagtgggcagtgtgttgttggggaagaacatgggcttctgaatcagaaaaatatgaattcaaaacctaccgctgtctcttgttagtcaggggaccttggccaagtctcaataaatgtttcttcatctgga

SEQ ID NO: 8895 - DNA, 2347 bp, Homo sapiens
  ENST00000381483
gaaagaatcaaagcgcacatcttgtactttgatgcccataggaagggctctcctctggcccctctggctttgtttggagcagaaaacaacaaactgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggcacatcaaatacgaaatccggacgtataaaccagacaattcataaaagagaaaataccagaaggaaacaaatattgaaaagtattcagtctcactcatcatcaaagacatgcaaatcacaaatcaagtcatctttttctgaattaataacccaaatgatggtacccagtggtgcttaggtgcggtaaaaccagcgcttgtccgatgcaccgttcgcgtggtaaactgacgcattcaggctcttgggaagcaatctgatgatatgtagtagctggttctgtaaatccacctttgagaatttaggcgaaggaagtaacgttctatatgtcaagatgtgcattgcagagggatttataaaggtgaatatttggaagaaataagagaatccacaatagagaccttgctaagtaaacggtggtgctcacgtatgatgggacattatggacacactaacagcactctttatgttggctgaaaatggcactgaaactgatgatagggtcatggttaaggaaagaatgcaagacccaaagtttatactgacaatcattgcagctatttgtaaggacagttttaatactaattccagcaatacatgtttttattccctgtcctggagtaggagaaagcctatattcccaggctgaatgttctacacatttaccactgtatatgcacatagggacagtgtaacctgtctataccaccgtagttccagtcctaactttctgaattctgtttaaagaccttct

SEQ ID NO: 8896 - DNA, 833 bp, Homo sapiens
  ENST00000470980
ggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacggtgagcctctgccagctcctggccaggcagtgcctgccatgctgcccggaggcagtggccaggcgggtgactgggcctgtgactgtgtgctgcaggggtcctctttgctcttcctctttgctttccctgaggtgtgagccatgcccctgggcccgcagcaggtgctggcccggcctgccctcctgaaacaggagctccagagacaccatcctgggatgctaaggcaggcctctgtgccactctttggacagtctcaactttaccagtggcttgggagccagacattcatttttctgtgttggttgcttggaacctagaatacattttccctactcaggcctgtttgcacagcatattgaactcacaagtgattaggaggaataatctttctttctttcttttttttttttgacggaatctcactctgttgcccaggctggagtgcagtggtgcaatctcagatcactgcaacctccgcctcccaggttcaagcaattctcctgcctcagcctcccaagtagctgggattataggcacatgccaccatgcctggctaatt

SEQ ID NO: 8897 - DNA, 2052 bp, Homo sapiens
  ENST00000432985
ctggtctctgtggtgatatattgtcccaactcaccttgccagacagccctgggagaatgcagggcagaatcctccctgcttggagtcagggaggcaagacctggcaggcagcacccagtgaagctctggaaggtgctctgcccacaaggtgtcccattggtggtgctggaggagtgacaggtggcggctgcttggctctgggcaagtccctccctccagccccctcacttgtaaaaaataagaggattggacgaaatgaaccagcaagtggcacagccccattggttagaaaaggtgactcctctcatcctaggctccaggagggtgagcaggtgcactcaatgagcaaggcttcccaggacagggcactcgagggacctggcgcagctcacctatctccttcagtgccctcacccccagagaacccacatgtatgggaccgtaagctgtgcacaagactgggtgccaagtcgctgctgttcctctgcaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccatgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactac

SEQ ID NO: 8898 - DNA, 5296 bp, Homo sapiens
  ENST00000396123
gctgatagagatgtcttggacatgctctggctggctaatctccatgttctagccgactgaaaatacggtggccaagtggatggtgtgcttatttgcagtctaaagaaatttccttttgatgtggcagaaaattgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgacctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatgta

SEQ ID NO: 8899 - DNA, 571 bp, Homo sapiens
  ENST00000472040
gtgcttatttgcagtctaaagaaatttccttttggtcagaagatatagttcaaggagtttaaattggtgtgggaggccatcaggattcctctgagctgggctggttgggaagggaggcgtctgtggctttatttctttttcgttatctgcagatgtggcagaaaattgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcgg

SEQ ID NO: 8900 - DNA, 8444 bp, Homo sapiens
  ENST00000234142
gaggcagctcctagtgaaacagtctaagaggtgtcaggctctgctgagtgctaaattagagaaagctgttacttatataacttcctgtaattgcccggcagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccatgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaattgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgacctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatg

SEQ ID NO: 8901 - DNA, 3020 bp, Homo sapiens
  ENST00000584446
cagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgcacaaaaagctttaaacaagttaaaatctaggcaacagactccctgaagtgttgactgcccaacttaatcatgactgtgattcaaaaatgttaataaataaaccaaggtgtagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcctgatcaggtacctctcagggaagaatttgagcaaattatgctgaaagctatgcaagaatttactctgagagaaagagccctgcagataggtgctcagtgtgtccctgtgtcaccaggacaactcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagctaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcaggtaagagtgaactttcaaagaggagcccacctagatccagcttcagatcccctctgcctctttcttttgcttaatccaaacgtctagaggatgcttaaaaccttcttcagtaataaaaatcataaaagcactttgttattttgggtttatctgaagttttccctcaaagtactctgtcctttttccctcaaggtcaagggtaaattgttgtgcatgtttgccaggtatcattaagttcatgatgtaatctgtgggactagaatctggtcatttatggatgaagagaaattttctcaaggcgaggatggccctgcatgggttgatggcgtctgtgccacctgaactcctcccacctgcaggcctcatttgcataggtggattcttggccatctagcacattaacagcacgtctgggacctggaaaccagaacaccatcccccatgtcagcaatgacgttctttaagaaaaaaaggttagcgttatttctaataactttaagtgtaaagaaaaaaaaatgtttttcccagaaaatgtgaaaaggtagagagcaaaaattttacaagtct

SEQ ID NO: 8902 - DNA, 5600 bp, Homo sapiens
  ENST00000269218
ccctggtcctctgccctcgcgccccgctagggccaggtgcacaaaaagctttaaacaagttaaaatctaggcaacagactccctgaagtgttgactgcccaacttaatcatgactgtgattcaaaaatgttaataaataaaccaaggtgtagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcagcaccagtcccgagctctggcagagagcatgctcaccacaagtgagtttttgaaagaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagctaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcaggtgtccttgtagacttgggtctggaggaaaatgggacagcccatcagagagcagaaaaatatgttgttcgtctagacaatgagattcaaaccaagtttgaagtttttatgaggagagtgaaacagaacccgtacacactgtttgtgctagttcatgacaactcccatgtggaactaacgagtgtcatttcaggctctttgtcacatagcgaacccagtcatgggctagctgatagagtcattaattgcagagaagttctggaagctttcaacctcctggtgctccaggtcagctccttcccatacactctgcagacccaacagtcccgcattagctctagcaatgaggttcactggatacagctggatactggggaggacgtgggctgcgaggagaagctgtactttggcttgagtgagtacagcaagtctctgcagtgggggatcacgagcccacttctgagatgtgacgagacttttgaaaaaatggtgaacacactcttggagaggtaccccaggctgcacagcatggtcgtccgctgctatcttctcatccagcagtactctgaggccctgatggctctcaccaccatggcgtcactccgcgaccacagcacaccagaaacactcagcattatggatgacctcatcagctccccaggcaaaaacaaaagtgggaggggacacatgctcattatcagggtgccctcggtgcagctggcgatgttagccaaggagcggctacaggaggtgcgcgacaaactgggtctgcagtatcggtttgagatcatccttgggaacccggccaccgaactcagtgttgcaactcactttgtggcgcgattaaagagttggagaggaaatgaaccagaagagtggatccctcggacataccaagatttagacggtctaccttgtattgtgatattaactggcaaagatcctcttggagaaacctttcccaggtctttgaagtactgtgacctccggttaattgactcaagctatttaactcgcacggccttggagcaggaggtgggtctggcatgctgctatgtctcaaaagaggtcatccggggacccactgttgccctggacctcagcgggaaggagcaggagagagctgctgtcagtgagaatgactccgatgagctgctcatcgacctggagcggccccagagcaacagcagcgctgtcacagggacctcgggttccatcatggagaatggagtgagctcttccagcacagctgacaagtcccagaagcagtccctgacccccagctttcagagcccagccaccagcttggggctggatgaaggggtctccgccagctcagctggagccggagccggggagactctgaagcaggaatgtgactccctgggcccccagatggcgagcagcaccacctccaagccgtcatcatcatcctcaggacccaggaccctcccatggccgggacagcccatcagaggctgccggggcccacaggcagccctgccaccagtggtgatcctatccaaagcggcctacagtctcctgggctcccagaagagtggcaagctgccatcctcctcctccctgctgccccacgccgacgtggcctgggtgagctccctgcggccactcctgaacaaggacatgagcagtgaggagcagtccctctactacaggcagtggaccttggcccggcagcaccacgctgactatagcaaccagctggacccggcctctggcacccgaaacttccacccccgacggctcctgctgacagggcccccacaggtgggaaagacgggctcctatttacagttcctcaggatcctcttccgcatgctcatcaggctcctggaggtggacgtgtatgatgaggaggagatcaacaccgatcacaatgaaagcagtgaagtgagccagtcagagggagagccctggcctgacatcgagagcttcagtaaaatgccttttgatgtcagtgtgcatgaccccaagtacagtttgatgagcctggtgtatactgagaagctggcaggggtcaaacaagaagtgataaaggaatccaaagttgaagagcccaggaaacgggaaactgtatccataatgctgaccaaatatgcagcctataacacctttcaccactgtgaacagtgccgccagtacatggacttcacctctgcctcccagatgtctgactccacccttcatgccttcacattctcttcttctatgctgggagaagaggttcagctctatttcatcattcccaaatccaaagagagtcattttgtcttcagcaagcagggcaagcacctggagagcatgcggctgcccctggtttcagacaagaatttgaatgcagtcaagagccctattttcactccttccagtggtcgacatgagcacggactcctaaaccttttccacgccatggagggcatcagccaccttcacctcctggtggtcaaagagtatgagatgcctctgtaccgcaagtactggcccaaccacatcatgctggtgcttcccggcatgttcaataatgcaggcgtgggtgctgccaggttcctcatcaaggagctatcatatcacaacctagaattggagagaaaccgcctggaggagctaggcattaaacgccagtgtgtctggcctttcatcgtcatgatggatgactcatgtgtcctatggaacattcacagtgttcaggagccatccagccagcccatggaagtaggagtttccagtaagaatgtgtccttgaagactgtcttgcagcacattgaagccacaccaaaaattgtccactatgcaatcttgggcatacagaaatggagcagcaagctgacttctcagagcctaaaggccccattctctaggtgtcacgtgcatgatttcattctcctcaacacagacttgactcagaatgtgcagtatgacttcaacaggtatttctgtgaagatgctgactttaatctgagaacaaacagtagtggcctgctcatctgccgctttaataacttcagtctcatgaagaaacatgttcaggttggagggcaaagggactttatcattaaaccaaagatcatggtgtcagagagcttagcacccatcttgccccttcaatacatctgtgctcccgacagtgaacacacactactggcagcccctgcacagtttctcctggagaaattccttcagcacgcctcatataaactcttccccaaagccatccataacttcaggagtcctgtgctggccattgactgctaccttaacattggaccagaggtggccatatgctatatcagctccagaccccactccagcaatgtcaactgtgaaggggtgtttttcagtggactccttttgtacctctgtgactcttttgtaggtgctgatcttaagaaatttaaatttctaaaaggtgctacactgtgtgtcatctgccaagacagaagttccttgcgccaaacaattgtccgcttagagctagaagatgagtggcagttccgcctccgggacgagtttcaaactgctaacagcagtgatgacaagcctctctactttcttactggacgtcatgtatga

SEQ ID NO: 8903 - DNA, 8749 bp, Homo sapiens
  ENST00000580732
gtttctgagagcatctgtcactttaggcattacaagatggatgggtctccagtgaactgctggttgaagcaaatggtgaaaataagaaaatcaaggggtttcagggtctgcagaggggacagacaacaaggaaacactgttagaaatcaagagtaagctgagcaatagaggaagagagcaaagatggatcagatgtcattttataaacatcttggaaatcagaatcttttggtggctttcgtgatctgagggagacatctgcatcatggtgcacaaaaagctttaaacaagttaaaatctaggcaacagactccctgaagtgttgactgcccaacttaatcatgactgtgattcaaaaatgttaataaataaaccaagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcctgatcaggtacctctcagggaagaatttgagcaaattatgctgaaagctatgcaagaatttactctgagagaaagagccctgcagataggtgctcagtgtgtccctgtgtcaccaggacaactcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagctaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcaggtgtccttgtagacttgggtctggaggaaaatgggacagcccatcagagagcagaaaaatatgttgttcgtctagacaatgagattcaaaccaagtttgaagtttttatgaggagagtgaaacagaacccgtacacactgtttgtgctagttcatgacaactcccatgtggaactaacgagtgtcatttcaggctctttgtcacatagcgaacccagtcatgggctagctgatagagtcattaattgcagagaagttctggaagctttcaacctcctggtgctccaggtcagctccttcccatacactctgcagacccaacagtcccgcattagctctagcaatgaggttcactggatacagctggatactggggaggacgtgggctgcgaggagaagctgtactttggcttgagtgagtacagcaagtctctgcagtgggggatcacgagcccacttctgagatgtgacgagacttttgaaaaaatggtgaacacactcttggagaggtaccccaggctgcacagcatggtcgtccgctgctatcttctcatccagcagtactctgaggccctgatggctctcaccaccatggcgtcactccgcgaccacagcacaccagaaacactcagcattatggatgacctcatcagctccccaggcaaaaacaaaagtgggaggggacacatgctcattatcagggtgccctcggtgcagctggcgatgttagccaaggagcggctacaggaggtgcgcgacaaactgggtctgcagtatcggtttgagatcatccttgggaacccggccaccgaactcagtgttgcaactcactttgtggcgcgattaaagagttggagaggaaatgaaccagaagagtggatccctcggacataccaagatttagacggtctaccttgtattgtgatattaactggcaaagatcctcttggagaaacctttcccaggtctttgaagtactgtgacctccggttaattgactcaagctatttaactcgcacggccttggagcaggaggtgggtctggcatgctgctatgtctcaaaagaggtcatccggggacccactgttgccctggacctcagcgggaaggagcaggagagagctgctgtcagtgagaatgactccgatgagctgctcatcgacctggagcggccccagagcaacagcagcgctgtcacagggacctcgggttccatcatggagaatggagtgagctcttccagcacagctgacaagtcccagaagcagtccctgacccccagctttcagagcccagccaccagcttggggctggatgaaggggtctccgccagctcagctggagccggagccggggagactctgaagcaggaatgtgactccctgggcccccagatggcgagcagcaccacctccaagccgtcatcatcatcctcaggacccaggaccctcccatggccgggacagcccatcagaggctgccggggcccacaggcagccctgccaccagtggtgatcctatccaaagcggcctacagtctcctgggctcccagaagagtggcaagctgccatcctcctcctccctgctgccccacgccgacgtggcctgggtgagctccctgcggccactcctgaacaaggacatgagcagtgaggagcagtccctctactacaggcagtggaccttggcccggcagcaccacgctgactatagcaaccagctggacccggcctctggcacccgaaacttccacccccgacggctcctgctgacagggcccccacaggtgggaaagacgggctcctatttacagttcctcaggatcctcttccgcatgctcatcaggctcctggaggtggacgtgtatgatgaggaggagatcaacaccgatcacaatgaaagcagtgaagtgagccagtcagagggagagccctggcctgacatcgagagcttcagtaaaatgccttttgatgtcagtgtgcatgaccccaagtacagtttgatgagcctggtgtatactgagaagctggcaggggtcaaacaagaagtgataaaggaatccaaagttgaagagcccaggaaacgggaaactgtatccataatgctgaccaaatatgcagcctataacacctttcaccactgtgaacagtgccgccagtacatggacttcacctctgcctcccagatgtctgactccacccttcatgccttcacattctcttcttctatgctgggagaagaggttcagctctatttcatcattcccaaatccaaagagagtcattttgtcttcagcaagcagggcaagcacctggagagcatgcggctgcccctggtttcagacaagaatttgaatgcagtcaagagccctattttcactccttccagtggtcgacatgagcacggactcctaaaccttttccacgccatggagggcatcagccaccttcacctcctggtggtcaaagagtatgagatgcctctgtaccgcaagtactggcccaaccacatcatgctggtgcttcccggcatgttcaataatgcaggcgtgggtgctgccaggttcctcatcaaggagctatcatatcacaacctagaattggagagaaaccgcctggaggagctaggcattaaacgccagtgtgtctggcctttcatcgtcatgatggatgactcatgtgtcctatggaacattcacagtgttcaggagccatccagccagcccatggaagtaggagtttccagtaagaatgtgtccttgaagactgtcttgcagcacattgaagccacaccaaaaattgtccactatgcaatcttgggcatacagaaatggagcagcaagctgacttctcagagcctaaaggccccattctctaggtgtcacgtgcatgatttcattctcctcaacacagacttgactcagaatgtgcagtatgacttcaacaggtatttctgtgaagatgctgactttaatctgagaacaaacagtagtggcctgctcatctgccgctttaataacttcagtctcatgaagaaacatgttcaggttggagggcaaagggactttatcattaaaccaaagatcatggtgtcagagagcttagcacccatcttgccccttcaatacatctgtgctcccgacagtgaacacacactactggcagcccctgcacagtttctcctggagaaattccttcagcacgcctcatataaactcttccccaaagccatccataacttcaggagtcctgtgctggccattgactgctaccttaacattggaccagaggtggccatatgctatatcagctccagaccccactccagcaatgtcaactgtgaaggggtgtttttcagtggactccttttgtacctctgtgactcttttgtaggtgctgatcttaagaaatttaaatttctaaaaggtgctacactgtgtgtcatctgccaagacagaagttccttgcgccaaacaattgtccgcttagagctagaagatgagtggcagttccgcctccgggacgagtttcaaactgctaacagcagtgatgacaagcctctctactttcttactggacgtcatgtatgagcttttgaagagaccaaaacagcaaaaagatgcctaggtgggatgggacagaaacaatttgggatttttctttttcctttaaagtacaatcactgtggagcaaagtgcaacatatttgtctaaattctccaaagaactccccaaatctgatccaggtctttggggacatcactttccttcagttccaattacaggacccttaaattcaggtaaactctatcctaggcagttatgcaattacttaagatacggtctgcccatgggatcctgaggaggatatactttggagagtgaatatggagtttgcattatttttttctattactatgttagggggaaactgactgtcaggattaactagcctgaatgtgttacatgagactcatgccattggtgtggaatcaattgaagattaacgtttgaggcctgaaccctcagtttctcttcagatctgtactttggtacagtattactcaggggtttgaaatgatagaatgtagacgatatttgtatttaaaaaaagaagtagctttgtctttctctgtgcagtgttagtttaagatttataatcttctatgtattgaaacttttggcaaaatttccacaggagttagaagtttactatttaaactgaacaaacaaatcagtaaatgcagagcaggcattgtgtgcatttatgcatcttctcctagcctaattcctttgctttacccactctttaaatgtgtttccagtctttaagaatatcttatctatgagactatggaacagtgattaatcttttgcaagaacttaagtcagttaagaagctttcagcaggtaacctgcacccaccgtttggttggaattaagcagttggcaccagcaaacctaaatgtcaggctgaggttctgttgcagagtgaaactagtttgtttcctttcagggactcaagcaaagcttcctttaaaagatgcactaaatattaccaccttacactgacaacgccacagaaattgccgaattgggaaattgagccatagaaagagaaatgtttttttacttaatcttaccagtgactcttgtgaggagtaaggaagactccattaagagtctttttgattcattaaaatcagcagggggtgtttgtccagtatcggcaatgggaggcatatgtttctacagatttctcaaatattttaatcaaaaacattatttttagaaagtgttctagataaaactaagtcttagaagtttactcttaaattactccagttctcatcattgaacaatctcttgagagttttctcattagcccatatttactactttatccccacttaaaatggccatttttacttgaatcaatcttgtttgtgacctgaaactactgaggggcctactaagcctgcatttacttagaacaaatagtgttaattgaccagctttattatcttatgacaacaaggagtttacaaagctagtgaaaaaatggaatgtattagactaaaaatggtttgcagatctcttggttttaatatagctacttataatgctttaactgtattttgaagtgaacaattccttttaaccccatttttaattgtccttcaaagaggacctgccttatatatgctttaaaaaatactccttaattttagtacagcagaatttttggtaaagaggtatgttttgaagcaatttggtttaaatatgaatgtatttcacttgttcctgttttgttgaaagggcctaatgcaaataataccaagaaacccactgtctgtgcaatattccaataacatttacatagggcaaataaaatacttgaaagaattctgaaacaattgtacctggggtggatggcctctcagggtttcttctggctttatgacttcatagtttaaagaactttttttttaagtagttacatcagatgcaggtactccattagttagggctgcactctgaaaattcaaattattattatgagctcttaaatactatttaactctggaagagatatgccagaataaagccaaaagaccatcacccctataatggagaaattgatctgcctattcttttcaaagcctatcttactaatgtttggatcttttaaaatcatcttatcatcagtataattcttgagtatgttaggtccttctttaaggataaaattgcacaagcacaggacaccatgatttgtgtgtatatatatatatatcctagtgtgttcagctttaagctttgcaatcccttaggacactgatgtgggatgaatggattcgctaggcccacacagtaactcacctgtagacctgctgaacctcagcatgtatgacagttcacacaggttaatactgaatgtaaacgaaaaactagaagacaattgttataattttttttggctgtaatttatgcaattgctttttgtgatttttagaaaatggggcacccgtgttattactgtaaaatgttcttaaccaaaatttggtgaatttcactagtctacctcacattttgttaatgattcaaaattgtcttgtgtctactgttatatttttgtcctttgatttaatttgcttaatgtattaaagttatctcccaccccctc

SEQ ID NO: 8904 - DNA, 2446 bp, Homo sapiens
  ENST00000578368
ttaaacaagttaaaatctaggcaacagactccctgaagtgttgactgcccaacttaatcatgactgtgattcaaaaatgttaataaataaaccaaggtgtagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcctgatcaggtacctctcagggaagaatttgagcaaattatgctgaaagctatgcaagaatttactctgagagaaagagccctgcagataggtgctcagtgtgtccctgtgtcaccaggacaactcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagctaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcaggttccagtccaggttcacacattgcattcagttatgtcctcttcatctcctgcaatctatgacatttcttcagtctttcctggcttttcatgaccttaagtgaatactaatcaattgttttgtgtagggaatgtttgagttttctcacaattaaattga

SEQ ID NO: 8905 - DNA, 598 bp, Homo sapiens
  ENST00000579454
gaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagattcgccgattctcagtccagctaattctgcaatcaatttaagtggagctcaggacctgacccggaataacaatgttgtgaaaccactggctttatctttgcaggttgtagggaagacttttgctgcagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagcccctt

SEQ ID NO: 8906 - DNA, 682 bp, Homo sapiens
  ENST00000581327
ctcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctgggtaatgtcatctcagaccaagaggaggaagtcagtccttgggacagacattgtaaaaactaagtcattctaagggttttgaggattcttcaagtcacagaccacaacagccttttcctgattgtctacatgataaacctggttgaaattaaaaatgctttcccatgtggcctggatcaaaggctttgttcctagtaaaagtcttctggaatgaaaa

SEQ ID NO: 8907 - DNA, 444 bp, Homo sapiens
  ENST00000580683
tcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagcttatcacaggaaaggtcagtttcctggcatcacatttcaaaaccacatcattaggtgagtggttgtaagatttggcaacactggcagcccctagttgtatgattttctgagtttaaatcttagcctgtcaagatgagtgtggagctcaagcttgccagctgatctttcatttgaaatggtttatcctaagtattttgtcactaacaccacaggaagcagtaagggggtctagaggaaggcccattggtactggattcaaaagtctcagctcag

SEQ ID NO: 8908 - DNA, 2882 bp, Homo sapiens
  ENST00000578955
tatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagctaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcagtgtcatttcaggctctttgtcacatagcgaacccagtcatgggctagctgatagagtcattaattgcagagaagttctggaagctttcaacctcctggtgctccaggtcagctccttcccatacactctgcagacccaacagtcccgcattagctctagcaatgaggttcactggatacagctggatactggggaggacgtgggctgcgaggagaagctgtactttggcttgagtgagtacagcaagtctctgcagtgggggatcacgagcccacttctgagatgtgacgagacttttgaaaaaatggtgaacacactcttggagaggtaccccaggctgcacagcatggtcgtccgctgctatcttctcatccagcagtactctgaggccctgatggctctcaccaccatggcgtcactccgcgaccacagcacaccagaaacactcagcattatggatgacctcatcagctccccaggcaaaaacaaaagtgggaggggacacatgctcattatcagggtgccctcggtgcagctggcgatgttagccaaggagcggctacaggaggtgcgcgacaaactgggtctgcagtatcggtttgagatcatccttgggaacccggccaccgaactcagtgttgcaactcactttgtggcgcgattaaagagttggagaggaaatgaaccagaagagtggatccctcggacataccaagatttagacggtctaccttgtattgtgatattaactggcaaagatcctcttggagaaacctttcccaggtctttgaagtactgtgacctccggttaattgactcaagctatttaactcgcacggccttggagcaggaggtgggtctggcatgctgctatgtctcaaaagaggtcatccggggacccactgttgccctggacctcagcgggaaggagcaggagagagctgctgtcagtgagaatgactccgatgagctgctcatcgacctggagcggccccagagcaacagcagcgctgtcacagggacctcgggttccatcatggagaatggagtgagctcttccagcacagctgacaagtcccagaagcagtccctgacccccagctttcagagcccagccaccagcttggggctggatgaaggggtctccgccagctcagctggagccggagccggggagactctgaagcaggaatgtgactccctgggcccccagatggcgagcagcaccacctccaagccgtcatcatcatcctcaggacccaggaccctcccatggccgggacagcccatcagaggctgccggggcccacaggcagccctgccaccagtggtgatcctatccaaagcggcctacagtctcctgggctcccagaagagtggcaagctgccatcctcctcctccctgctgccccacgccgacgtggcctgggtgagctccctgcggccactcctgaacaaggacatgagcagtgaggagcagtccctctactacaggcagtggaccttggcccggcagcaccacgctgactatagcaaccagctggacccggcctctggcacccgaaacttccacccccgacggctcctgctgacagggcccccacaggtgggaaagacgggctcctatttacagttcctcaggatcctcttccgcatgctcatcaggctcctggaggtggacgtgtatgatgaggaggagatcaacaccgatcacaatgaaagcagtgaagtgagccagtcagagggagagccctggcctgacatcgagagcttcagtaaaatgccttttgatgtcagtgtgcatgaccccaagtacagtttgatgagcctggtgtatactgagaagctggcaggggtcaaacaagaagtgataaaggaatccaaagttgaagagcccaggaaacgggaaactgtatccataatgctgaccaaatatgcagcctataacacctttcaccactgtgaacagtgccgccagtacatggacttcacctctgcctcccagatgtctgactccacccttcatgccttcacattctcttcttctatgctgggagaagaggttcagctctatttcatcattcccaaatccaaagagagtcattttgtcttcagcaagcagggcaagcacctggagagcatgcggctgcccctggtttcagacaagaatttgaatgcagtcaagagccctattttcactccttccagtggtcgacatgagcacggactcctaaaccttttccacgccatggagggcatcagccaccttcacctcctggtggtcaaagagtatgagatgcctctgtaccgcaagtactggcccaaccacatcatgctggtgcttcccggcatgttcaataatgcaggcgtgggtaaggggcccccctgggatggggagaagggcttcgaagataaactgagctccattcccctggcatgaaactttcagattcccctgcctctagaaattgtcctgccctcctcaccactcttcgg

SEQ ID NO: 8909 - DNA, 605 bp, Homo sapiens
  ENST00000578383
atgtgcctgaaggaagtgtgtcaactttccactaatcacatattcagttcctttgaaattaaaagaagtttcacttagtgcctcagagatgactgcagagttggtgtcgggttacataatgaaacagtattttttcttacttgtcaggaaataacctcttacagcggtcatttctgtaaaccccactttctggaaaacaagacacactgtatcctgtcctcattgggtttttgctctgtattttgaaccaggaggacgtgggctgcgaggagaagctgtactttggcttgagtgagtacagcaagtctctgcagtgggggatcacgagcccacttctgagatgtgacgagacttttgaaaaaatggtgaacacactcttggagaggtaccccaggctgcacagcatggtcgtccgctgctatcttctcatccagcagtactctgaggccctgatggctctcaccaccatggcgtcactccgcgaccacagcacaccagaaacactcagcattatggatgacctcatcagctccccaggcaaaaacaaaagtgggaggggacacatgctcattatcagggtgccctcggtgcagctggcgatgtta

SEQ ID NO: 8910 - DNA, 568 bp, Homo sapiens
  ENST00000580384
acgccagtgtgtctggcctttcatcgtcatgatggatgactcatgtgtcctatggaacattcacagtgttcaggagccatccagccagcccatggaagtaggagtttccagtaagaatgtgtccttgaagactgtcttgcagcacattgaagccacaccaaaaattgtccactatgcaatcttgggcatacagaaatggagcagcaagctgacttctcagagcctaaaggccccattctctaggtgtcacgtgcatgatttcattctcctcaacacagacttgactcagaatgtgcagtatgacttcaacaggtatttctgtgaagatgctgactttaatctgagaacaaacagtagtggcctgctcatctgccgctttaataacttcagtctcatgaagaaacatgttcaggttggagggcaaagggactttatcattaaaccaaagatcatgccatccataacttcaggagtcctgtgctggccattgactgctaccttaacattggaccagaggtggccatatgctatatcagctccagaccccactccagcaatgtcaactgtg

SEQ ID NO: 8911 - DNA, 6052 bp, Homo sapiens
  ENST00000424526
cagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgcacaaaaagctttaaacaagttaaaatctaggcaacagactccctgaagtgttgactgcccaacttaatcatgactgtgattcaaaaatgttaataaataaaccaaggtgtagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcctgatcaggtacctctcagggaagaatttgagcaaattatgctgaaagctatgcaagaatttactctgagagaaagagccctgcagataggtgctcagtgtgtccctgtgtcaccaggacaactcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagctaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcaggtgtccttgtagacttgggtctggaggaaaatgggacagcccatcagagagcagaaaaatatgttgttcgtctagacaatgagattcaaaccaagtttgaagtttttatgaggagagtgaaacagaacccgtacacactgtttgtgctagttcatgacaactcccatgtggaactaacgagtgtcatttcaggctctttgtcacatagcgaacccagtcatgggctagctgatagagtcattaattgcagagaagttctggaagctttcaacctcctggtgctccaggtcagctccttcccatacactctgcagacccaacagtcccgcattagctctagcaatgaggttcactggatacagctggatactggggaggacgtgggctgcgaggagaagctgtactttggcttgagtgagtacagcaagtctctgcagtgggggatcacgagcccacttctgagatgtgacgagacttttgaaaaaatggtgaacacactcttggagaggtaccccaggctgcacagcatggtcgtccgctgctatcttctcatccagcagtactctgaggccctgatggctctcaccaccatggcgtcactccgcgaccacagcacaccagaaacactcagcattatggatgacctcatcagctccccaggcaaaaacaaaagtgggaggggacacatgctcattatcagggtgccctcggtgcagctggcgatgttagccaaggagcggctacaggaggtgcgcgacaaactgggtctgcagtatcggtttgagatcatccttgggaacccggccaccgaactcagtgttgcaactcactttgtggcgcgattaaagagttggagaggaaatgaaccagaagagtggatccctcggacataccaagatttagacggtctaccttgtattgtgatattaactggcaaagatcctcttggagaaacctttcccaggtctttgaagtactgtgacctccggttaattgactcaagctatttaactcgcacggccttggagcaggaggtgggtctggcatgctgctatgtctcaaaagaggtcatccggggacccactgttgccctggacctcagcgggaaggagcaggagagagctgctgtcagtgagaatgactccgatgagctgctcatcgacctggagcggccccagagcaacagcagcgctgtcacagggacctcgggttccatcatggagaatggagtgagctcttccagcacagctgacaagtcccagaagcagtccctgacccccagctttcagagcccagccaccagcttggggctggatgaaggggtctccgccagctcagctggagccggagccggggagactctgaagcaggaatgtgactccctgggcccccagatggcgagcagcaccacctccaagccgtcatcatcatcctcaggacccaggaccctcccatggccgggacagcccatcagaggctgccggggcccacaggcagccctgccaccagtggtgatcctatccaaagcggcctacagtctcctgggctcccagaagagtggcaagctgccatcctcctcctccctgctgccccacgccgacgtggcctgggtgagctccctgcggccactcctgaacaaggacatgagcagtgaggagcagtccctctactacaggcagtggaccttggcccggcagcaccacgctgactatagcaaccagctggacccggcctctggcacccgaaacttccacccccgacggctcctgctgacagggcccccacaggtgggaaagacgggctcctatttacagttcctcaggatcctcttccgcatgctcatcaggctcctggaggtggacgtgtatgatgaggaggagatcaacaccgatcacaatgaaagcagtgaagtgagccagtcagagggagagccctggcctgacatcgagagcttcagtaaaatgccttttgatgtcagtgtgcatgaccccaagtacagtttgatgagcctggtgtatactgagaagctggcaggggtcaaacaagaagtgataaaggaatccaaagttgaagagcccaggaaacgggaaactgtatccataatgctgaccaaatatgcagcctataacacctttcaccactgtgaacagtgccgccagtacatggacttcacctctgcctcccagatgtctgactccacccttcatgccttcacattctcttcttctatgctgggagaagaggttcagctctatttcatcattcccaaatccaaagagagtcattttgtcttcagcaagcagggcaagcacctggagagcatgcggctgcccctggtttcagacaagaatttgaatgcagtcaagagccctattttcactccttccagtggtcgacatgagcacggactcctaaaccttttccacgccatggagggcatcagccaccttcacctcctggtggtcaaagagtatgagatgcctctgtaccgcaagtactggcccaaccacatcatgctggtgcttcccggcatgttcaataatgcaggcgtgggtgctgccaggttcctcatcaaggagctatcatatcacaacctagaattggagagaaaccgcctggaggagctaggcattaaacgccagtgtgtctggcctttcatcgtcatgatggatgactcatgtgtcctatggaacattcacagtgttcaggagccatccagccagcccatggaagtaggagtttccagtaagaatgtgtccttgaagactgtcttgcagcacattgaagccacaccaaaaattgtccactatgcaatcttgggcatacagaaatggagcagcaagctgacttctcagagcctaaaggccccattctctaggtgtcacgtgcatgatttcattctcctcaacacagacttgactcagaatgtgcagtatgacttcaacaggtatttctgtgaagatgctgactttaatctgagaacaaacagtagtggcctgctcatctgccgctttaataacttcagtctcatgaagaaacatgttcaggttggagggcaaagggactttatcattaaaccaaagatcatggtgtcagagagcttagcacccatcttgccccttcaatacatctgtgctcccgacagtgaacacacactactggcagcccctgcacagtttctcctggagaaattccttcagcacgcctcatataaactcttccccaaagccatccataacttcaggagtcctgtgctggccattgactgctaccttaacattggaccagaggtggccatatgctatatcagctccagaccccactccagcaatgtcaactgtgaaggggtgtttttcagtggactccttttgtacctctgtgactcttttgtaggtgctgatcttaagaaatttaaatttctaaaaggtgctacactgtgtgtcatctgccaagacagaagttccttgcgccaaacaattgtccgcttagagctagaagatgagtggcagttccgcctccgggacgagtttcaaactgctaacagcagtgatgacaagcctctctactttcttactggacgtcatgtatgagcttttgaa

SEQ ID NO: 8912 - DNA, 564 bp, Homo sapiens
  ENST00000439493
agagcgagaaaagcaaacccaacccgtcggggccgccgctccggacccgcagccgccgccgccgcctcctccccccggatcgggtgtactgtcccaacccgaaagtccagttctgcggcccggcagcggcgagcgggcgcgatgacacaggagtacgacaacaaacggccagtgttggttcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaaggtaacattcagtgcctaacagcataaagagtgcagggggaaatgccacgtttctgtaacagcaaaatgggagtttgtttaaatgaacaaccactagtgaaagagatagaaacagcataccaattgtgacagagcagcccctcatc

SEQ ID NO: 8913 - DNA, 5400 bp, Homo sapiens
  ENST00000497403
agagcgagaaaagcaaacccaacccgtcggggccgccgctccggacccgcagccgccgccgccgcctcctccccccggatcgggtgtactgtcccaacccgaaagtccagttctgcggcccggcagcggcgagcgggcgcgatgacacaggagtacgacaacaaacggccagtgttggttcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaaggtaacattcagtgcctaacagcataaagagtgcagggggaaatgccacgtttctgtaacagcaaaatgggagtttgtttaaatgaacaaccactagtgaaagagataggtaagttggactcttactatctaaattcagatttcatcactgatttgcctctgttgctctgaaatttccttttttctttgggcgtagtagttgccttttctaggatgaaagcactaacattctcctcctccaaagggatagttttagtaataacttcagtatttgcttatttgtttttgaggttttctttagaaggatgtgtggcagtggtctattaaaaaaattaagcaccagtgactcttgaacaactgcctgagtaaaattgaataaagcaagttaaattgtattcaaattcctgttgaaattatttgtgaaatattttagattaaaactttcagaaaatttaattaacgtttggctagccatgaaaaactttaaaaagacaccttttaaattgtcttgtgttttattatcaatcaaggaatgaaacatatttaaaggaagaatgatcatcacccagtatcccattatcgtgatgattgctttattcattgttttgatgtgtatgcaaattttatgtagcgtagttgtgttcacagataggatttggtagtgtactttcttctacttagtttgtttcataaacattttctctgtattttaatcttcataattatcctttggaagaggacttgtggcttttatcttttacttttcattatgggcattttcaaacataataaaaatagaaaaacagtataagcccacatgtatccatgaccagcctcaacagttatcaacacaattcctcttgtttgatttgttcttccctcttcttcaactttgagattaattcatgtttttattttatttatttttgctggaacattctgaagcaaactgtaaatatccttacaattgctgctatatctagttttcactattaagaagtcttaaggaacaactttctagactttttccgttttaggataaattcctgggagtgaatttatggttcagggttcaaacagttttattgatcttgaaatgtacagaattctcaatttgcctgtttcttgaagcttcagcctatatgatttctgggggctttgaaaattcattcattttacccactggaaatcatcttgtattgctcaaattatttatcaaaccaaaatttaattttataaaaagcagatgtgtctactgatgcaatgtaacaataggttttcttgggtgaaagagaaagccaggcccggcacagtggctcatgcctgtaatcgcagcgctttgggaggctgaggcaggtggatcacctgaggtcaggagttcgagaccagcctggccaacatggtaaaacccagtctctactaaaaatacaaaaattagccaagtgtggtggcgtgcgcctgtaatcccagctactcgggaggctgaggtgggagaatcgcttgaacccgggaggcggaggttgcagtgagcctagatcacgccattgcacaccagcctgggccataagggcaagactctgtctcaaaaaaataaaaaattaaaaaaaaaaaaaggagaaagccaaatggcataggtggtaggaaaagtggtgaccaagtaataatagctcatacttcttgaagactgtgtgtcaggcattattatacaccttttagtgtatcatctcatctcaacctgatgagaatggatgccattattgtccccattttgcagatgaggattcagttactaagagatgaagtaacttgctcaggtgacacagaacttgaacccaggcaatttgaccctggcgtctatgctgtaaccccagttgatcagatcgcatagcttcaggtttctagtaaaacacagtaattgtttttaggattatggaaagtaaagcttgttagaggagagctctgagcccttagtatttcgaatgaaattttacttaataggtttggattttatttgaccgataaccagaaagcctttttccctttatctagtaatgggtagttttgatgttttctgtttattctgtcaagtgttattgcacaggacccaacagcccaatgccattaggaaaataaaaattgtcaaagaactacatcagcatcgcgtttgaaagcagttttcttttcttaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggttttcttcccctcggatctcagtctgcggatgcctggcatgaattcagaggactatgtttttgacagtgtttctgggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacataggtaagcagctcaagagcccgcttttattcccagaggtgcagccatccagttttctaaatccaattatttttggcagtgatcagcttcctgccgaaagcatttgaatttttatgccagctactgatctgttccaaacactgtcctcggcctcctggaaccagtgctctcaccattgctcccatgcagtaatgggacatgtgcccacgtggtggctttccacaggacactagggccagaagccatgtagctggctaacctgagaatgtccccactgttcagtctgcaattgctttaaggggtaatatcttctttaaaagattctgattattatttggagatgatggaggtagagaaaaaaacaagtaaaagaaagatattgctgctgtgcagttgcctaacagtcttccctagtcacgtgctaaaccgtgtaactaacctctctgtgggctgtagtggcaaacctgtgcaaatctgtatttactgaagtagcgttacacagacctctgttcttgccatgtatgtaattttcatgtaaaaccattgtctgtatcacagatggctgtttaatattagtgttactttttttctttaccttttgtaatgctcttgtttccttttcaggagaatgagaactcagttctaatcttggttctacagagtagttttgtgaccttgggactgttatttaaactttttagacttaaatttcctaattgtgacataatgagattgaattaaatatgtctaagcttgcctctattacaaaaactctgtgattctttttcttcgtattttgaacttcttctaatcgaacaaaatgttaatttaaattgtccagaggtgataatgctaaaaactagatcttattttgaactgctgggatcccatgttgaaactaagactcatgagttttcattttctcttccaccgcttcctgtagctgactataaagaaagcttcaacactatcagtaacatcgaggagattgcgtataacgccatttccttcacatgggacatcaacgatgaagcaaaggtgggtggtgaggtctgggcgccttatgtccagccatttgagaaatgggaggagtttaatgatttgacaactgatttttttttttttcacagttttatgtgtttcattctcaggtgttatgaaactatcctcttccctttttattctcccctcctccaaaacagatcatttttgttgccatcctttgcacagagtccagtgtgtgaaacattgagattaagttgcactctgccactcctgcctgttcagccttgagtctgactcctcatttgctttgcctcatttcctcatttgcacagtggaggtgatatctgtctcctccctctattgaaggaggtgtaaggagtaatgaaacaatgcccatcaaactgttggagtggctttgagaaaggctcttaaatataagtgattattagtagtactctgtttcatatcatcaccttgtaaatatgactctgtgttaagattcttctgtcttgggcttttcccattgaagagttgcctccagttcagttggagtaactctaattggctagagttactccttgtgggcgactctaatgggaatttttgtgcccttgaagaaaaattcagcatattcctaagtcctttctgccttgcccctgccttcttccctgtgagtgtgatccttctccactcaattattagagttcctgtatttctttctttctttggattactttaaaaactgggagctcaagaaactgaatagaggccagaagtggtggctcacacttgtaatcccagcactttgggaggctgcggcgggtgggtcacttgaggccaggagtttgagaccagcctggccaacatggtgaaaccctgtctctactaaaaatacaaaaagtagccaggcgtggtggcacacgcttctaatcccagctactctggaggttgaggcaggagaatcgcttgaacccgggagacgggggttacagtgagctgagatcacgccactgcactccagcctaggcaacagagtgagaccctgtccccccc

SEQ ID NO: 8914 - DNA, 2099 bp, Homo sapiens
  ENST00000464418
agagcgagaaaagcaaacccaacccgtcggggccgccgctccggacccgcagccgccgccgccgcctcctccccccggatcgggtgtactgtcccaacccgaaagtccagttctgcggcccggcagcggcgagcgggcgcgatgacacaggagtacgacaaaatatgcagttaaattattgcctgaaacatatttcagaagtctgagagatcgcagacgcggagtttaaggctcacctgaaagtgatgatgagccttcggcgactgaagcctacttcctgactgtcatgaggaagtggactaagaaaggcaactgcaaacggccagtgttggttcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtccttcccattgcctctgaagaattggagggtgaaggctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctcccca

SEQ ID NO: 8915 - DNA, 3563 bp, Homo sapiens
  ENST00000324907
gagaaaagcaaacccaacccgtcggggccgccgctccggacccgcagccgccgccgccgcctcctccccccggatcgggtgtactgtcccaacccgaaagtccagttctgcggcccggcagcggcgagcgggcgcgatgacacaggagtacgacaacaaacggccagtgttggttcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggttttcttcccctcggatctcagtctgcggatgcctggcatgaattcagaggactatgtttttgacagtgtttctgggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtccttcccattgcctctgaagaattggagggtgaaggctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctccccaggagttcagtgcaggtgtttctagatcttacggtttggcaactgcaggtaaccccagtcagccatgtcgccagcacaggtctatgtcgagggaatgggttccttgcaggttggaggcggggctgcatctggcttggtggtagcatttaatctattgcattggtgtttttcagatgaaagagaaatccatataccattatgtttgaatttcctgatatatacaggatttaaagtgaaaactttattccaagagttaacagagtctctgggaagctttaggacatctgctacgttatttatcaaaatattgggatctctgccttgtgcctacagtgtcgtgggcctgctcgctagcagaagtcagaaaaggcgataggcttggctttaaggatttcgtgcccttgcctgaattcagtacaactccactgcctcacgttagcgggagcgcacctgaagagtacggggggagccctctctcccttaccctctcactctccaccagatgtttactaaacagggcatgttactgaaatcttcctttgcgactttctcggacatatcaactgcctttctcatgaagaattttaatgggttacagtatgaaatcagttaagataaagctgcattgtatataagtgcaatatatttttgaaggtctgtaaatgtgtacatacatgtcttatataaatatataatatataaatatggtgtctgtgtacatatagtgaagatatgcagtaagagctaccttaaagactttccctagacaaaggttaagttattttttgatcgtgtataccaagcagatagaatactgtgcttagtggaacccgctaaaaacctttttctctgtttttccaaacacaggcattctgtagcatagcaaaaccttctcaaatgacagagattctgtttgctgttgagaatgttgttatttggatttctgcactgtttaacaaatgaagtaaaagaaaaacactactgcaatcacgtcttttgttatgctagtatcagtcagatgcacttagagtgaagaaacactgtaattacagcacacagattgcaagtattgcgtaccaagtgatacaactcgaaatgcagttctcatcttcctgttttgagaaatgattattttatcacgcatcagagccttcgtgctttgattatcttgtatgttaacaattctagaaaacattcatgaattcacaaaaatatgttactatggcaggggaacattttgtacacatttaagtatataaaaatactaaaatatgtaattttataacaaagtcacgggtatctttaggttcagggaactagactaggtcattcgtgtaaatggactggtagttacagtcttaggttaaagtattctaatgaagtatgggaactaaattgctggttttctaagataagatatgggatatgggtcatataacttttgtattttttatgaagttgattttgtcttgcgtgttatttttaattgtatcattgaagatgtattttaaaccaaaggaattaaattttatatgtctatttcgtaa

SEQ ID NO: 8916 - DNA, 2060 bp, Homo sapiens
  ENST00000472167
tgtcccaacccgaaagtccagttctgcggcccggcagcggcgagcgggcgcgatgacacaggagtacgacaacaaacggccagtgttggttcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggttttcttcccctcggatctcagtctgcggatgcctggcatgaattcagaggactatgtttttgacagtgtttctgggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaaggcaagtgtcctgaccccagctcccagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtccttcccattgcctctgaagaattggagggtgaaggctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctccccaggagttcagtgcaggtgtttctagatcttacggtttggcaactgcaggtaaccccagtcagccatgtcgccagcacaggtctatgtcgagggaatgggttc

SEQ ID NO: 8917 - DNA, 780 bp, Homo sapiens
  ENST00000494520
cagcccaatgccattaggaaaataaaaattgtcaaagaactacatcagcatcgcgtttgaaagcagttttcttttcttaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggttttcttcccctcggatctcagtctgcggatgcctggcatgaattcagaggactatgtttttgacagtgtttctgggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcact

SEQ ID NO: 8918 - DNA, 572 bp, Homo sapiens
  ENST00000480736
agacagccaggcgtggtggatcatgcctataattccagcactttgggaggccaagctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctccccaggagttcagtgcaggtgtttctagatcttacggtttggcaactgcaggtaaccccagtcagccatgtcgccagcacaggtctatgtcgagggaatgggttccttgcaggttggaggcggggctgcatctggcttg

SEQ ID NO: 8919 - DNA, 1881 bp, Homo sapiens
  ENST00000405379
ataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtccttcccattgcctctgaagaattggagggtgaaggctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctccccaggagttcagtgcaggtgtttctagatcttacggtttggcaactgcaggtaaccccagtcagccatgtcgccagcacaggtctatgtcgagggaatgggttccttgcaggttggaggcggggctgcatctggcttggtggtagcatttaatctattgcattggtgtttttcagatgaaagagaaatccatataccattatgtttgaatttcctgatatatacaggatttaaagtgaaaactttattccaagagttaacagagtctctgggaagctttaggacatctgctacgttatttatcaaaatattgggatctctgccttgtgcctacagtgtcgtgggcctgctcgctagcagaagtcagaaaaggcgataggcttggctttaaggatttcgtgcccttgcctgaattcagtacaactccactgcctcacgttagcgggagcgcacctgaagagtacggggggagccctct

SEQ ID NO: 8920 - DNA, 2069 bp, Homo sapiens
  ENST00000481559
aaaaactgtattctgtggcggctagtggctgctgctttgcatttaacactactatcctgaacacagctgatctctctacaggttatttcagcagaagccctggtctaggagagtctatgaagttccagcttacaccagacatgaccagcatccagaaagacctgaaagaagcttgaatcctctcactagaatccctgcaaaatgactcatgtaattgctctgtggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtcagtcagctcttctcaatccctttgcctaatgctatggttttgtttgtttgtttgtttgtttgttttttaaatactgaaaagtaaagagatgaattatttcag

SEQ ID NO: 8921 - DNA, 362 bp, Homo sapiens
  ENST00000520353
tgacttacagctgaacccacattcccagcagcttcagcctgggggctgggggagcgggcagaccgagctcagaaaggcaggggagggtaaagaggactgtggggttgcccctttcaggaccaagtgccacgtgtcacacacccccacctccacctttctgcacacacagaaaggaggataaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagat

SEQ ID NO: 8922 - DNA, 586 bp, Homo sapiens
  ENST00000518862
aggtcggctgtggaactccaagctagctcgggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatctt

SEQ ID NO: 8923 - DNA, 5708 bp, Homo sapiens
  ENST00000285900
gtgtgagggggagagcgagagagagcaagggagggagagagaggcaggctgcgaggggagaggagagggagtgggggagccagcgctccagctagcatgaggacgggcttcttttcccgtgctcagttaatctggctgtcagttggtgttaacgctgcagtttaagtgttcggattccaagggaaacagacaaacctcacgaaaggaaggaagcaagcaagcaaggaaggaactgcaggaggaaaagaacaggcagaacagcgagaagaataaagggaaagggggggaaacaccaaatctatgattggacctgggcttctttttcgccaatgcaaaaaggaatatgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttttttcttactaatatccatggtttgcaggttctgttaggccctttccttctccttacttcttatccccaactccctacccacccctcttcagttttcagattggagattcaagatttgttccactttacaagcaagaggaaaaaaaagcaaccttcaaactaattctccatgggggctctccatgttaccctccactccttggcccaaacctctgatggagatagacattgttggagaagtgggctgccttccccaagtggggcactgcttaagcacttattcagtggagaacacaggtgaaaagcaactcaggatgagggtggtggagagggcaggggcagatgtgcagtcagagaaggactcctgaagttactgctgctcagaaaaacagttcctttaatgtggaagagccatttcataggtcataggtggtatggtatatttcttcagagtcaaccttggccctgagaagtatgtcctcctggtgtgctcaggctcaacggcagtctggtggctgaaggcacttggcctcctaaaccaagcagaattttgggaagagataacagccagggagatattgcccatgattctcactttttctttgcctggcatctaagcaggaacccattgtggagtagactctcttcttctatggagcctctgacatggggagcaatgctaagcaagctaagtgtaaaagaaaagtgacagaataattttggaagaggaagcctcatcaaaagctcacacaaaatagagcttcccatggtgtgccctatcctaggtttaagaaaacacgtatgaagtttatgctgatgcaaagaacttgggtttttatgttaatataaagtgttgttttagcatgtggccagatgatgctctgtcatctttagaaagtgagataaccaaggaaataattgaaggagtatagggagatggattaagttgataatgacatttagggcaacttaagacctttgatcccaggttctaactcaaagaggctgaccttcccccagctaagatagcatgaggacgttgtattccaatatacgtatgattggggctacaaagctgaactaaagcaagattggtgaagtggcagggtttatagagagaagcccaggctgagttcagcttttgttggaagtgagaatccctgacatatagctttcttggagatcccaactctcattcttggtgcaactggcttccagctctccagcagtcactctcctaggtgcatgattcagtgcgtgccatgtgtcattagcttttactgataaccatattctggcttgttcccttaccccctacttctatccaattttctctgctaggggttatcattagcaattgacatgctaaaggttttggagcccacctaggggtaggtgcagctttattggcttttctgtggattctctcagtggacccacaccatctctatgtctctccactctcctgccttcagccatagcaaagaatccttccaaaatcaaactcttcacttttttgactcaagtgttgttgttcagtctctcgcgtgtcaatgtggtcatggttcatgaaaccggaccctcaagatggatgattgcttttaactactgccagctgatgtctctcagcccctgccctcatacaagatttttctcagccttcagcctaccactgcagaatccgatgtgacccaccattagggagtctgcatcttggaagagttggaaataaccctttaacatcaacatgcttcaaagactttttgcctttggcctagtaagatgcctctccagctactgagcccacaagtaacatgagcggataaaaagagacttgtttgtgctagaaatgagggtctatgctatgagggggtccaagactctggcgaaatgtgctttttcatcaatggagaaatgaaaggaaaacacaagcaagaaaaaagttaacttgtattatgtatttttactacacttttcttaaaaatagagcattgggaaaactctgaaagagactgacatttttctcaacaggaatccatacttaacagttctggctttcattaaattttgctctttggtacctgggccttttatttaacatctatatttgttttaactctcttggcagatgtgtgaaaggattcttgcttgatcaaacactaagtatttttttggttcttgtttttctttcaaatagccaggtttttttcttttggtatttgcataaaatgaaaatatcaccgaatattaaatcactgtggatccatta

SEQ ID NO: 8924 - DNA, 734 bp, Homo sapiens
  ENST00000474198
gaggacgggcttcttttcccgtgctcagttaatctggctgtcagttggtgttaacgctgcagtttaagtgttcggattccaagggaaacagacaaacctcacgaaaggaaggaagcaagcaagcaaggaaggaactgcaggaggaaaagaacaggcagaacagcgagaagaataaagggaaagggggggaaacaccaaatctatgattggacctgggcttctttttcgccaatgcaaaaaggaatatgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagatgtaagtaattgcttctatttctgagatgtctttctgcgctagaccaatgaaaggagggcctgtgggtaggtggtggtgttgcaaaaatgacttcagttgccattcgtctttgtaagagaaagccctccaagaaaaatttctagaggcttctgagtgattccagcagttggcattttagcccctgcaatgcttcatgtaatggatttgctttttcactgtcagctaactttaatgccagcacgatgggtgcttgggttgactgcatcttc

SEQ ID NO: 8925 - DNA, 2761 bp, Homo sapiens
  ENST00000518142
tcttttcccgtgctcagttaatctggctgtcagttggtgttaacgctgcagtttaagtgttcggattccaagggaaacagacaaacctcacgaaaggaaggaagcaagcaagcaaggaaggaactgcaggaggaaaagaacaggcagaacagcgagaagaataaagggaaagggggggaaacaccaaatctatgattggacctgggcttctttttcgccaatgcaaaaaggaatatgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagatgcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccag

SEQ ID NO: 8926 - DNA, 3170 bp, Homo sapiens
  ENST00000340592
taaagggaaagggggggaaacaccaaatctatgattggacctgggcttctttttcgccaatgcaaaaaggaatatgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaggtcccgtaaacctagcggttttgaaactcagtgagcaaggcgtcttagacaagctgaaaagcaaatggtggtacgataaaggggaatgtggaagcaaggactccggaagtaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttt

SEQ ID NO: 8927 - DNA, 572 bp, Homo sapiens
  ENST00000517469
cgcactccaggcaagagcatgtgaaatggaggaaccatcgctttggaggaaaaaaaaaatcaggctggaaagggtggtgggtgtttaaggagttaactctattgcttggtagatggtgcttgattccatttttaatggggattatttccaaaccagcagtcacaggaacatgctgcttttagatttgctttgtcgcaactcacagagcccccgaagctgctcccccagattgatattgtgaacatcagcgacagctttgagatgacctatagatcttgtccggctgaaaggtcttcagtggcaatagcacgcatggagctgtcatcacctataacactgccttcttctggaatacctcctgaaggacttgcctgaggctattttacagctacctttttttataagtagaaagagtgcactgtaaaataacaacatatatagtaaatgtataaaccagttacataactgcttattatcaagtattatgtactgtacatgactgtatgtgttatacttttatatacaaccacagcacagtaggtttgtttaagccagcatcaccacaaacacat

SEQ ID NO: 8928 - DNA, 3069 bp, Homo sapiens
  ENST00000521843
attgcttggtagatggtgcttgattccatttttaatggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttttttcttactaatatccat

SEQ ID NO: 8929 - DNA, 2825 bp, Homo sapiens
  ENST00000448073
gtgcaattgatattttgtcgggcatacatgtgctgcagtacccatctctttcagcctctccagctagctggcggcttggagtggccatggagtaacttgctttgtttcctgacacctgttaagctacatcctgaagtgtggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaggtcccgtaaacctagcggttttgaaactcagtgagcaaggcgtcttagacaagctgaaaagcaaatggtggtacgataaaggggaatgtggaagcaaggactccggaagtaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagc

SEQ ID NO: 8930 - DNA, 5233 bp, Homo sapiens
  ENST00000518783
gtgcaattgatattttgtcgggcatacatgtgctgcagtacccatctctttcagcctctccagctagctggcggcttggagtggccatggagtaacttgctttgtttcctgacacctgttaagctacatcctgaagtgtggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttttttcttactaatatccatggtttgcaggttctgttaggccctttccttctccttacttcttatccccaactccctacccacccctcttcagttttcagattggagattcaagatttgttccactttacaagcaagaggaaaaaaaagcaaccttcaaactaattctccatgggggctctccatgttaccctccactccttggcccaaacctctgatggagatagacattgttggagaagtgggctgccttccccaagtggggcactgcttaagcacttattcagtggagaacacaggtgaaaagcaactcaggatgagggtggtggagagggcaggggcagatgtgcagtcagagaaggactcctgaagttactgctgctcagaaaaacagttcctttaatgtggaagagccatttcataggtcataggtggtatggtatatttcttcagagtcaaccttggccctgagaagtatgtcctcctggtgtgctcaggctcaacggcagtctggtggctgaaggcacttggcctcctaaaccaagcagaattttgggaagagataacagccagggagatattgcccatgattctcactttttctttgcctggcatctaagcaggaacccattgtggagtagactctcttcttctatggagcctctgacatggggagcaatgctaagcaagctaagtgtaaaagaaaagtgacagaataattttggaagaggaagcctcatcaaaagctcacacaaaatagagcttcccatggtgtgccctatcctaggtttaagaaaacacgtatgaagtttatgctgatgcaaagaacttgggtttttatgttaatataaagtgttgttttagcatgtggccagatgatgctctgtcatctttagaaagtgagataaccaaggaaataattgaaggagtatagggagatggattaagttgataatgacatttagggcaacttaagacctttgatcccaggttctaactcaaagaggctgaccttcccccagctaagatagcatgaggacgttgtattccaatatacgtatgattggggctacaaagctgaactaaagcaagattggtgaagtggcagggtttatagagagaagcccaggctgagttcagcttttgttggaagtgagaatccctgacatatagctttcttggagatcccaactctcattcttggtgcaactggcttccagctctccagcagtcactctcctaggtgcatgattcagtgcgtgccatgtgtcattagcttttactgataaccatattctggcttgttcccttaccccctacttctatccaattttctctgctaggggttatcattagcaattgacatgctaaaggttttggagcccacctaggggtaggtgcagctttattggcttttctgtggattctctcagtggacccacaccatctctatgtctctccactctcctgccttcagccatagcaaagaatccttccaaaatcaaactcttcacttttttgactcaagtgttgttgttcagtctctcgcgtgtcaatgtggtcatggttcatgaaaccggaccctcaagatggatgattgcttttaactactgccagctgatgtctctcagcccctgccctcatacaagatttttctcagccttcagcctaccactgcagaatccgatgtgacccaccattagggagtctgcatcttggaagagttggaaataaccctttaacatcaacatgcttcaaagactttttgcctttggcctagtaagatgcctctccagctactgagcccacaagtaacatgagcggataaaaagagacttgtttgtgctagaaatgagggtctatgctatgagggggtccaagactctggcgaaatgtgctttttcatcaatggagaaatgaaaggaaaacacaagcaagaaaaaagttaacttgtattatgtatttttactacacttttcttaaaaatagagcattgggaaaactctgaaagagactgacatttttctcaacaggaatccatacttaacagttctggctttcattaaattttgctctttggta

SEQ ID NO: 8931 - DNA, 419 bp, Homo sapiens
  ENST00000492291
ctcacagagcccccgaagctgctcccccagattgatattgtgaacatcagcgacagctttgagatgacctatagatcctagtgcagtgattctcagctgggagtgattttgcccctttcccttcctgggggacatgtggcaatgtctggagacacttttaagtgtcacaactcaggactggagaactactattgacatttaggtaaaagcaatggatgtgctaaccatcctgtaatgcacagaacaaacccctacaacaaataattatctgggctaaaatgtcaataatgctgaggttaagaaacctcattctattttttgtactcattaactatccccctcaaaacatctcatgtaccccataaatatatatacctactatgtaccacaaaattaaaaataaaaaagagtataaaatt

SEQ ID NO: 8932 - DNA, 560 bp, Homo sapiens
  ENST00000520966
atattttatgttgggctaggggcctgcctggaggacatttacaagtgttcagtggctggtaactgaattagagtgcctggagatatagtctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgc

SEQ ID NO: 8933 - DNA, 784 bp, Homo sapiens
  ENST00000616590
cgctttggcaaacccagcttgcagccaatgaacccgccttccagattggtgtgaagacagaagtgagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtcctgctgaaagggactacctgccttggccaggaagcatcagggaaaacaattggacagctctgccgtgctgcaaagatcatgggctgctgcacctaaaatgttcaccaggtggggcccgccaaaactgggcctattgtatctggggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaa

SEQ ID NO: 8934 - DNA, 936 bp, Homo sapiens
  ENST00000611689
cgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtcctgctgaaagggactacctgccttggccaggaagcatcagggaaaacaattggacagctctgccgtgctgcaaagatcatgggctgctgcacctaaaatgttcaccaggtggggcccgccaaaactgggcctattgtatctggggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaa

SEQ ID NO: 8935 - DNA, 2740 bp, Homo sapiens
  ENST00000541091
tgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaatgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaagaaatgctgttaacctggcagtattaaaactgaatgagcaaggcctcttggacaaattgaaaaacaaatggtggtacgacaaaggagagtgcggcagcgggggcggtgactccaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctaggg

SEQ ID NO: 8936 - DNA, 4943 bp, Homo sapiens
  ENST00000620443
tgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaatgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaagaacgcctgtaaaccttgcagtattgaaactcagtgaacaaggcatcttagacaagctgaaaaacaaatggtggtacgataagggggaatgtggagccaaggactccgggagtaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcgtaatttgcatgtgtgggcataaactacagagcctcattgccatgaggtattgtacaaagttttaatacattttgtaaataaaattgtaaagaaagaa

SEQ ID NO: 8937 - DNA, 644 bp, Homo sapiens
  ENST00000479118
caaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaa

SEQ ID NO: 8938 - DNA, 506 bp, Homo sapiens
  ENST00000477389
ggttgtgatcctagggaaacactcaagaggttatcactacatgctcgctaacctgttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagactctctctaacatggcgctgtttgtcaacgttagtcccagaattagccatcatgtgtacaatctgtcagtcaagcagcctctcaatctctcatggtcttcttcttctgttctctactttccctttctttgttccgacattttttatgttctaaataaaaaattcaaatgctcaaa

SEQ ID NO: 8939 - DNA, 554 bp, Homo sapiens
  ENST00000460123
tactgttgtaatatattataatgttccattgcctttgttttccccaagatctaatcacgttgttcatttctcttaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgctt

SEQ ID NO: 8940 - DNA, 5173 bp, Homo sapiens
  ENST00000622768
agagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaatgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaagaaatgctgttaacctggcagtattaaaactgaatgagcaaggcctcttggacaaattgaaaaacaaatggtggtacgacaaaggagagtgcggcagcgggggcggtgactccaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcgtaatttgcatgtgtgggcataaactacagagcctcattgccatgaggtattgtacaaagttttaatacattttgtaaataaaattgt

SEQ ID NO: 8941 - DNA, 2991 bp, Homo sapiens
  ENST00000620581
agcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaatgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaagaaatgctgttaacctggcagtattaaaactgaatgagcaaggcctcttggacaaattgaaaaacaaatggtggtacgacaaaggagagtgcggcagcgggggcggtgactccaagaacgcctgtaaaccttgcagtattgaaactcagtgaacaaggcatcttagacaagctgaaaaacaaatggtggtacgataagggggaatgtggagccaaggactccgggagtaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtg

SEQ ID NO: 8942 - DNA, 5834 bp, Homo sapiens
  ENST00000327946
actgcaccgggaccagcgcctccccgcttcgcgctgccctcggcctcgccccgggcccgggtggatgagccgcgcgcccgggggacatggaagcgctgacgctgtggcttctcccctggatatgccagtgcgtgtcggtgcgggccgactccatcatccacatcggtgccatcttcgaggagaacgcggccaaggacgacagggtgttccagttggcggtatccgacctgagcctcaacgatgacatcctgcagagcgagaagatcacctactccatcaaggtcatcgaggccaacaacccattccaggctgtgcaggaagcctgtgacctcatgacccaggggattttggccttggtcacgtccactggctgtgcatctgccaatgccctgcagtccctcacggatgccatgcacatcccacacctctttgtccagcgcaacccgggagggtcgccacgcaccgcatgccacctgaaccccagccccgatggtgaggcctacacactggcttcgagaccacccgtccgcctcaatgatgtcatgctcaggctggtgacggagctgcgctggcagaagttcgtcatgttctacgacagcgagtatgatatccgtgggcttcaaagctttctggaccaggcctcgcggctgggccttgacgtctctttacaaaaggtggacaagaacattagccacgtattcaccagcctcttcaccacgatgaagacagaggagctgaatcgctaccgggacacgcttcgccgcgccatcctgctgctcagcccacagggagcccactccttcatcaacgaggccgtggagaccaacctggcttccaaggacagccactgggtctttgtgaatgaggaaatcagtgacccggagatcctggatctggtccatagtgcccttggaaggatgaccgtggtccggcaaatctttccgtctgcaaaggacaatcagaaatgcacgaggaacaaccaccgcatctcctccctgctctgcgacccccaggaaggctacctccagatgctgcagatctccaacctctatctgtatgacagtgttctgatgctggccaacgcctttcacaggaagctggaggaccggaagtggcatagcatggcgagcctcaactgcatacggaaatccactaagccatggaatggtgggaggtccatgctggataccatcaaaaagggccacatcactggcctcactggggtgatggagtttcgggaggacagttcgaatccctatgtccagtttgaaatccttggcactacctatagtgagacttttggcaaagacatgcgcaagttggcgacatgggactcagagaagggcttgaatggcagcttgcaagagaggcccatgggcagccgcctccaaggattgactcttaaagtggtgactgtcttggaagagcctttcgtgatggtggctgagaacatcctaggacagcccaagcgctacaaagggttctccatagatgtcctggatgcactggccaaggctctgggctttaaatatgagatttaccaagcccctgatggcaggtacggtcaccagctccataacacctcctggaacgggatgatcggggagctcatcagcaagagagcagacttggccatctctgccatcaccatcaccccagagagggagagcgttgtggacttcagcaagcggtacatggactattcagtggggattctaattaagaagcccgaggagaaaatcagcatcttctccctctttgctccatttgatttcgctgtgtgggcctgcattgcagcagccatccctgtggttggtgtgctgatatttgtgttgaacaggatacaggctgtgagggctcagagtgctgcccagcccaggccgtcagcttctgccactctgcacagcgccatctggattgtctatggagccttcgtacagcaaggtggcgaatcttccgtgaactccatggccatgcgcatcgtgatgggcagctggtggctcttcacgctcattgtgtgctcctcctacacagccaaccttgctgccttcctcacagtgtccaggatggacaaccccataaggactttccaggacctgtccaaacaagtggaaatgtcttatggcactgtccgggattctgctgtatatgagtacttccgagccaagggcaccaaccccctggagcaggacagcacgtttgctgaactctggcggaccatcagcaagaacggaggggctgacaactgcgtgtccagtccttcagaaggcatcaggaaggcaaagaaggggaactacgccttcctgtgggatgtggccgtggtggaatacgcagccctgacggatgacgactgctcggtgactgtcatcggcaacagcatcagcagcaagggttacgggattgccctgcagcatggcagcccctacagggacctcttctcccagaggatcctggagctgcaggacacaggggacctggatgtgctgaagcagaagtggtggccgcacatgggccgctgtgacctcaccagccatgccagcgcccaggccgacggcaaatccctcaagctgcacagcttcgccggggtcttctgcatcctggccattggcctgctcctggcctgcctggtggctgccctggagttgtggtggaacagcaaccggtgccaccaggagacccccaaggaggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctgactgcgccgcctgccctcctgcccaccctcccacccacccgaccagcagagctttttaatacaagaaaacaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgtgatcattctgaagtgccaaaggagcccccccattcctgggcctttctgagggcaggaggggcgaccagataaggagcccctctctgctgggggagaagggaagacgaggaaccccacatgccactcgctgccttgtcccacagcttgctgccccatttctttgctcctggcacctcgtcccttttagtccctcagcttgataaagagtgagtttggagcccgcattgggctggcccactgggttgctgtgctgtagggtgatcggctgttctgggtagcctggggctgaggaggtgccctggactcagggctatcctgtcctgtcttggatcttgcgggacgagttagtcaccgctgtgtgtgttgcagtgtgcctctgccccatgggcccgagagaagctgacaattacccatagtgaggtaattgagggctttgatactgagctgttctcatatcatactgttggccttgtttttcattttcttttcaaaattagaagaatcaaaaagtgatagaatattgggggaaggagggcagactccatcgtttcctcagggagactgggcggaggtggggttggtctggaagaaggtccatgggggcagggagttgcgaggtggggttagttgcatggaccaggtgaggtggtggaacaaaaggccaggtagaggaagaatattcccttgggtttggacccatggtcccaggtgagagaaggaagtgaggccatagatgcagggagtagaagctttgtggtgtcaggcaaacggactctgttagtaagagttgggggaggtgcccaggtgggtggaccagtactccaggtgatggggcatgctgagaaatagagaaaagagaccatgtttatttgggtaggaggaagccttgccttgcgccttaggtgagaagcataagtgtaactcccatccaccagggaagttgcttgtagccccaaaagtaaaggcctatctctgggtcataaatcctgcaggcagtccaacaaacagggctggctccagcacaaactctcccttccacctttacgaccctctccagaccagacctggagtcctcttcaagcagcaatccaacccagagcaggggccctccccactcaggcatctgataacctctgagatttccaggcctatccctgtgcaggtacagctgcagggaagcccagttttctaagcctaggaccacctaacagcgccccctccttcagttgccctttctgaggcaactaaactacagaatcagggaaagaaccattaggagtggaactgggggaatctgagttgtgtcacttcagttcctctcctaaagacaaaggttagtctgatctccagacccgtcagaatggaatacacagcccacatctgtcactgaaggaggtggagctcccacagccagcagtaatcagggagctgagagcctggttctgtgatcatggagaaatacaaagtcctattgattgcttcttctatagccttgtagagtttctagagagatgtatttatgagggtgataactagcccaggattgatttctttcctaaagtccctagtgacatgattgagcagtaaagaacggccaaatcacacagtcagctaaaagcactgtggggaagagagtgtttataattatgttatttattgctggatgctgagaatggtctgatattcgtgctacctaggcaatccattgacatttctccaatcagagcatgtggaccttggagccaggcatgctcagagaagcctaggtgggctaccatgaccccgaggaagagcaggctttgttttccatcagcacgttgggggccctgccctgaatggtcaatttttcacatatatatctctctatttttttaatcaaactctggtctcactgccttatctcacaccaactctgtttcctcattgccccctgagatggcctgtcttctggggtatagcttggatgtcttcttggatggttctgcttagaatgagtgtcaaggaggaaagagagggagatggaggatgtgtttgtgcgcctgtgtgtgtgtgtttgtgtgtgtgtgtgtgtgtgagagagagagagagagagagagagaccagcatcttcaagagaagtattctgcttatacaaaatccttaacacctcatggtgttattcttcaccatgtttatatatatatatatatatttttttttttttttagaattttctacccttggcatgaggggaaatgattgatattcaagcaagttctctaggaaaaaaaaaaacttcccaactcagatttctgtgtcagctcagaatgtatctttttttcatgctttgctctttggatttataactctgtttagactattccatacattttaggtatattttgtgccttcagacactgcaaataataatcagcatttggattaaagttgtttaataat

SEQ ID NO: 8943 - DNA, 787 bp, Homo sapiens
  ENST00000552278
tgggcagcgccagagagcccttccctaccctgccccgcccatgtgcctccaccctgacctggagagaccacctgtagggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctgactgcgccgcctgccctcctgcccaccctcccacccacccgaccagcagagctttttaatacaagaaaacaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgtg

SEQ ID NO: 8944 - DNA, 3243 bp, Homo sapiens
  ENST00000464741
ggggagcggcccgggactgcaccgggaccagcgcctccccgcttcgcgctgccctcggcctcgccccgggcccgggtggatgagccgcgcgcccgggggacatggaagcgctgacgctgtggcttctcccctggatatgccagtgcgtgtcggtgcgggccgactccatcatccacatcggtgccatcttcgaggagaacgcggccaaggacgacagggtgttccagttggcggtatccgacctgagcctcaacgatgacatcctgcagagcgagaagatcacctactccatcaaggtcatcgaggccaacaacccattccaggctgtgcaggaagcctgtgacctcatgacccaggggattttggccttggtcacgtccactggctgtgcatctgccaatgccctgcagtccctcacggatgccatgcacatcccacacctctttgtccagcgcaacccgggagggtcgccacgcaccgcatgccacctgaaccccagccccgatggtgaggcctacacactggcttcgagaccacccgtccgcctcaatgatgtcatgctcaggctggtgacggagctgcgctggcagaagttcgtcatgttctacgacagcgagtatgatatccgtgggcttcaaagctttctggaccaggcctcgcggctgggccttgacgtctctttacaaaaggtggacaagaacattagccacgtattcaccagcctcttcaccacgatgaagacagaggagctgaatcgctaccgggacacgcttcgccgcgccatcctgctgctcagcccacagggagcccactccttcatcaacgaggccgtggagaccaacctggcttccaaggacagccactgggtctttgtgaatgaggaaatcagtgacccggagatcctggatctggtccatagtgcccttggaaggatgaccgtggtccggcaaatctttccgtctgcaaaggacaatcagaaatgcacgaggaacaaccaccgcatctcctccctgctctgcgacccccaggaaggctacctccagatgctgcagatctccaacctctatctgtatgacagtgttctgatgctggccaacgcctttcacaggaagctggaggaccggaagtggcatagcatggcgagcctcaactgcatacggaaatccactaagccatggaatggtgggaggtccatgctggataccatcaaaaagggccacatcactggcctcactggggtgatggagtttcgggaggacagttcgaatccctatgtccagtttgaaatccttggcactacctatagtgagacttttggcaaagacatgcgcaagttggcgacatgggactcagagaagggcttgaatggcagcttgcaagagaggcccatgggcagccgcctccaaggattgactcttaaagtggtgactgtcttggaagagcctttcgtgatggtggctgagaacatcctaggacagcccaagcgctacaaagggttctccatagatgtcctggatgcactggccaaggctctgggctttaaatatgagatttaccaagcccctgatggcaggtacggtcaccagctccataacacctcctggaacgggatgatcggggagctcatcagcaagagagcagacttggccatctctgccatcaccatcaccccagagagggagagcgttgtggacttcagcaagcggtacatggactattcagtggggattctaattaagaagcccgaggagaaaatcagcatcttctccctctttgctccatttgatttcgctgtgtgggcctgcattgcagcagccatccctgtggttggtgtgctgatatttgtgttgaacaggatacaggctgtgagggctcagagtgctgcccagcccaggccgtcagcttctgccactctgcacagcgccatctggattgtctatggagccttcgtacagcaaggtggcgaatcttccgtgaactccatggccatgcgcatcgtgatgggcagctggtggctcttcacgctcattgtgtgctcctcctacacagccaaccttgctgccttcctcacagtgtccaggatggacaaccccataaggactttccaggacctgtccaaacaagtggaaatgtcttatggcactgtccgggattctgctgtatatgagtacttccgagccaagggcaccaaccccctggagcaggacagcacgtttgctgaactctggcggaccatcagcaagaacggaggggctgacaactgcgtgtccagtccttcagaaggcatcaggaaggatcctggagctgcaggacacaggggacctggatgtgctgaagcagaagtggtggccgcacatgggccgctgtgacctcaccagccatgccagcgcccaggccgacggcaaatccctcaagctgcacagcttcgccggggtcttctgcatcctggccattggcctgctcctggcctgcctggtggctgccctggagttgtggtggaacagcaaccggtgccaccaggagacccccaaggaggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctgactgcgccgcctgccctcctgcccaccctcccacccacccgaccagcagagctttttaatacaagaaaacaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgt

SEQ ID NO: 8945 - DNA, 6117 bp, Homo sapiens
  ENST00000282020
agtcccggttgaagattccatgggaaatgagagcactattttgtttctcccttgtattgcagatagggggaggaggtggttattagagagaagctcttcctctcttggtttccccctctctccgcctgacagcaccgctctctcgcaggctcgctccttctcctaggtgatccatttctaggcaacgtggggctggtgctgaagctgccaggctcgctccttgcttcctgcatcccgccaggcgaaacgctccaaaagcatcctgcagcctgcggcggcttccctcctctggcccggccccgctgctcgcgcccggcgcaacccccccgccaccgcgccccagcaaaccggctccccgggcccgcctcgccaagctgcgttccgcgcctcacgcagaaagggaattttctctgcattactatctgcattaccttgaagttcactttttctacccctcttggagagggcttttttcccccctccctggtggaatctggctgctccgtttggaatctcctaatctttcctttccacttagattctggcagcgaagaccagtgattctctgcgggctgtaggggcgggggcgggggtcttttttggtccgagagggtgcggggaagggggcacatccggcgtgaggggggtgttggaagttgcagcggagctgggaccggagacccgcggcccccgcgcagcgatgggtctgatctgagccccagcctctccccctgcccaagagcagtagaggctggatatatttttcaaaagccaaactgcaaacaactctggcgatgccaaaattcccctccaagtgacacggctttgcgaaggaggtttcctcaggctgggctctttctgtcattcccttctgcctttctcggcgacgataaaaggctttgctctggcaataggaatttagaaaaaaagaaaaagctgcgctaaactccaccgtgacctcaaactctttggactgtttgaaaaaaaaaaaattggaagaaaatccatcctccaagagaatcggcataggaggagatggaagttttcccctttctcttggttttgtccgtctggtggtctcgaacctgggactcggcgaatgcggattcgatcattcacatcggagcaatttttgatgaatctgccaaaaaggatgatgaggtatttcgcactgcggttggtgaccttaaccagaatgaggagatcttacagactgagaaaatcacattttcagtgacgtttgttgatggcaacaaccctttccaagcagttcaagaagcctgtgaacttatgaatcaaggcatcttggccctggtcagctccattggctgcacgtcagcaggatccctccagtctttggcagacgccatgcatatcccccacctcttcattcagcgctcaacagctgggaccccaaggagtggctgtggactcacccggagcaacaggaatgatgactacactctctcagttcgcccacctgtctacttgcatgatgttatcctaagagtggtcacagagtatgcctggcagaaattcattatattctatgatagtgaatacgatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgaggttgtggagactaatttggttgcttttgactgtcactggatcattataaatgaggaaataaacgatgtggacgtacaggaacttgtaagaaggtcaattggaaggttaacgattattcggcagacatttccagttccccagaacataagtcagcggtgtttccgtggcaaccatcgaatatcttcaacattgtgtgatccaaaggatccatttgctcagaatatggagatttccaacctttacatatatgacacggtgcttctgcttgctaatgcttttcataagaagctggaggaccgaaagtggcacagcatggcaagtctgtcatgtatcagaaagaactcaaagccctggcagggtgggcgctccatgttggagaccatcaagaagggtggagttagtgggttgactggagagctagaatttggagaaaatggaggcaatcccaatgtccactttgaaatccttggaaccaactatggagaagagcttggcagaggtgttcgaaaacttggttgctggaatcctgtcacaggtctgaatgggtcactgactgacaagaaattggagaataacatgcgtggagtggttctacgtgtagtaactgttctggaagaaccttttgtgatggtctctgaaaatgtcttgggtaagccgaagaaataccagggcttctccattgatgttttggatgccttatctaactacctgggttttaactacgaaatttacgtagcaccggatcacaaatacggaagcccacaagaagatgggacatggaatggcttggtaggagaacttgtctttaagagagccgacatagggatttctgctttaaccatcactccagatcgtgaaaatgtggtggactttacgacacgttacatggactactcagtgggggtactacttcgaagggctgaaaagacagtggatatgtttgcctgtcttgcaccatttgatctctctctatgggcttgcattgctggcacagtccttctggtgggtctactggtctacctcttgaactggcttaatcccccacgattacaaatgggatcaatgacgtctactactctctacaactccatgtggtttgtgtatggatcttttgtacaacaaggcggggaagtcccgtacacgactctggctacccgaatgatgatgggggcttggtggctatttgctttgattgttatctcatcttacacggcaaacctcgctgctttcctcactattacacgcattgaaagttccatccagtctctccaggacctttccaagcaaacagaaatcccttatggcacagtcctagactctgcggtatatgagcatgtccgcatgaaaggactgaatccttttgagagggacagcatgtattcccaaatgtggcggatgatcaaccgaagcaatggatcggagaacaatgttctggagtcccaggcaggcattcaaaaggtaaaatatggaaattatgctttcgtatgggatgcagctgtattggaatatgtggctatcaatgacccagattgttccttttacaccattggaaatactgttgctgatcggggatatggaattgcattacaacatggcagtccttaccgagatgttttttcacaaaggatcctggagcttcagcagaatggtgacatggacatcctgaagcacaaatggtggcctaagaatggccagtgtgacctgtactcgtcagtggacacaaagcagaaaggaggcgccctggacataaagagctttgcaggggtcttttgtatcctggctgctggaattgtcctctcctgcttcatagccatgctggagacgtggtggaacaagaggaaaggctcccgggttccatcaaaagaggatgacaaggaaattgacctggagcacctccatagacgtgtaaatagcttgtgcacagatgacgacagcccccataaacagttttccacctcgtcaattgatttgacccctctggacattgacactttgccaacacgacaagcactggagcaaatcagtgatttcaggaacactcatattaccacaacaacctttatcccagagcagatccagactcttagccgcacactgtcagctaaagctgcttctggtttcacttttggcaacgtgcctgagcaccgaactggcccttttaggcacagggcacctaatgggggctttttcaggagtcctataaaaacaatgtcatctattccttatcaaccaactcctaccctggggctcaatctgggtaatgatccagaccgaggcacctccatatgagcatcaaacaaatctcttcactgtttcttttttaggactccctttgcaaggagcaactgtaatattgtgggactaacatggatgtaacgtttaaaaaaaagatcaggattattagtaacaattctagttttttcctcccaccttctccctctcctctctcctctatgattttctctctttccccctcccttcctgtacattttcctccactttttttcattactcaacttgttccccaagaaggtagtgtactaggatcctattagtctgcttttcatatactgtacatcaagtataggaaatgtgcactgagtatactaaaagtatatgcaggattaattttacataaaggcctcttctgtaacatttctctattttttgaaatacaattgcaataacttcagtctttttacattcttctgctgcatccatacaatgctccactgctgttgagtgtcctttaactgtggaccaaaggcaacccctgcagtgtttataaaacaattttaagaccattcaggccacataagatgagaatgcaattttgtaggattacaaaaaagccattaatatgccagtcaagactacagttaaaactactcttgcactgcaacagtgcatatgacctttatgtgattgtacagtattaaaagttttttcttatgtacagtaaactttatcatatggcagaagcctctattgtgttaaataaattagtatttcatatatatacatatatatgcacctatataatgtgtatatatataaaaaggcagccattgctattgcaattcatttaataaagctttagtttaaacaaaagtattgtatacaggaactatgtatagtgcaggggttcttttcagttagaaaaggcaggttgctttaatgttattctgactcgcattgtttgccaacagaaaatattttatacttttgttattaaagcatccagggcaatttaatatttgttcctagatgtaactcatttgaataggttttgcatttgttattcagcagtgtataaagctaaccttgataattttacttttaattaattatctaaatgaaaaatgctattagctgaaccacatccacaacagcacatagagctctagaagagttgaaacatagatcattgaaggttaaaaatcctcttccaaagcagcaagtcaatcaatacaataatgatatttggggaggggtgggagcccttaagaactattgatgtggccttaaattactgtcatttattatcctaaagaagaaaacataataaccataatgggctctcaactcaactcccttttttatttagttctatttggaggagttatgtattttttacattagtgccaagtatatagaaggatgacagcaaaaacagtgcctctttgtgcacaatccttttaaagtagcattcttacttgttagaaatgtagaatgaactttgtttgtaatccttaaattaaaatgtggtaagtaggaagcaagaacttattctgtgtttttacgcagccatacacttactttaatctaactcattctgtggctaggattgatataggaatcaacctatgtgatttgctttaggagaaattaaaaggtatattcttaagatatattatattttgatgctaattctgttctggggagcatcttgtattgtcactgttttgtactaaatcttcaaatattgtctactgtgtaaggcagaaaaatttcttatcatgcaaaaaccattttgtttccagggtaacaagtaactaagtgcatgcacaacttgttttcccttgtaacattcatgatctcatttacaactctgattttaaaacaaaaaaatctttacaacaagctatatagggacataccagatgttgcagtgattttagctatcaacaaactgttaaccatgtacaatatttaaaataggcttattttgatgtatcgcctattatacaaacacacaaaacatttttggaggcctcagttatgagtgacagagctttctgtgtataatttgtctaaataatttgtctaataaaaatgttttctaaa

SEQ ID NO: 8946 - DNA, 1491 bp, Homo sapiens
  ENST00000505687
attcccttctgcctttctcggcgacgataaaaggctttgctctggcaataggaatttagaaaaaaagaaaaagctgcgctaaactccaccgtgacctcaaactctttggactgtttgaaaaaaaaaaaattggaagaaaatccatcctccaagagaatcggcataggaggagatggaagttttcccctttctcttggttttgtccgtctggtggtctcgaacctgggactcggcgaatgcggattcgatcattcacatcggagcaatttttgatgaatctgccaaaaaggatgatgaggtatttcgcactgcggttggtgaccttaaccagaatgaggagatcttacagactgagaaaatcacattttcagtgacgtttgttgatggcaacaaccctttccaagcagttcaagaagcctgtgaacttatgaatcaaggcatcttggccctggtcagctccattggctgcacgtcagcaggatccctccagtctttggcagacgccatgcatatcccccacctcttcattcagcgctcaacagctgggaccccaaggagtggctgtggactcacccggagcaacaggaatgatgactacactctctcagttcgcccacctgtctacttgcatgatgttatcctaagagtggtcacagagtatgcctggcagaaattcattatattctatgatagtgaatacgatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgaggttgtggagactaatttggttgcttttgactgtcactggatcattataaatgaggaaataaacgatgtggacgtacaggaacttgtaagaaggtcaattggaaggttaacgattattcggcagacatttccagttccccagaacataagtcagcggtgtttccgtggcaaccatcgaatatcttcaacattgtgtgatccaaaggatccatttgctcagaatatggaggtatattataaatgacaggatatttcttccagggtgctttgttgggcaattgcaaggagagctttatgagttgcattggattcagaattatacgtgttatttctgaacaattctcctccagcaatttcataagtctaatggggagaaagtgctaagaatttgcgtctttgttctttttgatctcattatagaaaaatttctacttgcttaataaaaaaatataataagtaaaggttattttcttctaaacaagtaggtccataacatttcccacaggagaatttgtaattggtactcctttttccaaactctaaattattaaactaataaatgtgcttgacttttctggcctaaga

SEQ ID NO: 8947 - DNA, 2739 bp, Homo sapiens
  ENST00000510992
atggaagttttcccctttctcttggttttgtccgtctggtggtctcgaacctgggactcggcgaatgcggattcgatcattcacatcggagcaatttttgatgaatctgccaaaaaggatgatgaggtatttcgcactgcggttggtgaccttaaccagaatgaggagatcttacagactgagaaaatcacattttcagtgacgtttgttgatggcaacaaccctttccaagcagttcaagaagatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgaggttgtggagactaatttggttgcttttgactgtcactggatcattataaatgaggaaataaacgatgtggacgtacaggaacttgtaagaaggtcaattggaaggttaacgattattcggcagacatttccagttccccagaacataagtcagcggtgtttccgtggcaaccatcgaatatcttcaacattgtgtgatccaaaggatccatttgctcagaatatggagatttccaacctttacatatatgacacggtgcttctgcttgctaatgcttttcataagaagctggaggaccgaaagtggcacagcatggcaagtctgtcatgtatcagaaagaactcaaagccctggcagggtgggcgctccatgttggagaccatcaagaagggtggagttagtgggttgactggagagctagaatttggagaaaatggaggcaatcccaatgtccactttgaaatccttggaaccaactatggagaagagcttggcagaggtgttcgaaaacttggttgctggaatcctgtcacaggtctgaatgggtcactgactgacaagaaattggagaataacatgcgtggagtggttctacgtgtagtaactgttctggaagaaccttttgtgatggtctctgaaaatgtcttgggtaagccgaagaaataccagggcttctccattgatgttttggatgccttatctaactacctgggttttaactacgaaatttacgtagcaccggatcacaaatacggaagcccacaagaagatgggacatggaatggcttggtaggagaacttgtctttaagagagccgacatagggatttctgctttaaccatcactccagatcgtgaaaatgtggtggactttacgacacgttacatggactactcagtgggggtactacttcgaagggctgaaaagacagtggatatgtttgcctgtcttgcaccatttgatctctctctatgggcttgcattgctggcacagtccttctggtgggtctactggtctacctcttgaactggcttaatcccccacgattacaaatgggatcaatgacgtctactactctctacaactccatgtggtttgtgtatggatcttttgtacaacaaggcggggaagtcccgtacacgactctggctacccgaatgatgatgggggcttggtggctatttgctttgattgttatctcatcttacacggcaaacctcgctgctttcctcactattacacgcattgaaagttccatccagtctctccaggacctttccaagcaaacagaaatcccttatggcacagtcctagactctgcggtatatgagcatgtccgcatgaaaggactgaatccttttgagagggacagcatgtattcccaaatgtggcggatgatcaaccgaagcaatggatcggagaacaatgttctggagtcccaggcaggcattcaaaaggtaaaatatggaaattatgctttcgtatgggatgcagctgtattggaatatgtggctatcaatgacccagattgttccttttacaccattggaaatactgttgctgatcggggatatggaattgcattacaacatggcagtccttaccgagatgttttttcacaaaggatcctggagcttcagcagaatggtgacatggacatcctgaagcacaaatggtggcctaagaatggccagtgtgacctgtactcgtcagtggacacaaagcagaaaggaggcgccctggacataaagagctttgcaggggtcttttgtatcctggctgctggaattgtcctctcctgcttcatagccatgctggagacgtggtggaacaagaggaaaggctcccgggttccatcaaaagaggatgacaaggaaattgacctggagcacctccatagacgtgtaaatagcttgtgcacagatgacgacagcccccataaacagttttccacctcgtcaattgatttgacccctctggacattgacactttgccaacacgacaagcactggagcaaatcagtgatttcaggaacactcatattaccacaacaacctttatcccagagcagatccagactcttagccgcacactgtcagctaaagctgcttctggtttcacttttggcaacgtgcctgagcaccgaactggcccttttaggcacagggcacctaatgggggctttttcaggagtcctataaaaacaatgtcatctattccttatcaaccaactcctaccctggggctcaatctgggtaatgatccagaccgaggcacctccatatga

SEQ ID NO: 8948 - DNA, 853 bp, Homo sapiens
  ENST00000515744
aacgaggatgccactcagagagaccagagggacaaacaccacagccagtcctgccacagccctgccacaaaaaacctgtgaacttatgaatcaaggcatcttggccctggtcagctccattggctgcacgtcagcaggatccctccagtctttggcagacgccatgcatatcccccacctcttcattcagcgctcaacagctgggaccccaaggagtggctgtggactcacccggagcaacaggaatgatgactacactctctcagttcgcccacctgtctacttgcatgatgttatcctaagagtggtcacagagtatgcctggcagaaattcattatattctatgatagtgaatacgatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgaggaaacttcattatgcagtttaaagacaaattatacacattttactttttgagttcagcaaatgacttagagaatcttattgaactactacattttttcataatataaaatatttccaattttaaagaagttgggtctttccttcaagaaacacaaatctggaagatgggagtgagtacacagaggatgtaatataaattaggatgttaaaattgcaatagaggcggttgaagcatctatggtcatttttgttggaggagatcagagaaaacctcactgagcaggtata

SEQ ID NO: 8949 - DNA, 768 bp, Homo sapiens
  ENST00000502699
aacgaggatgccactcagagagaccagagggacaaacaccacagccagtcctgccacagccctgccacaaaaaacctgtgaacttatgaatcaaggcatcttggccctggtcagctccattggctgcacgtcagcaggatccctccagtctttggcagacgccatgcatatcccccacctcttcattcagcgctcaacagctgggaccccaaggagtggctgtggactcacccggagcaacaggaatgatgactacactctctcagttcgcccacctgtctacttgcatgatgttatcctaagagtggtcacagagtatgcctggcagaaattcattatattctatgatagtgaatacgatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgagatgtcgttttagaaaaacacttagggaggaaagaatgtgagtgatttttgttttcatgccagagcacagacacttacgtgacaattggagtaaataaagtaaaaggagcaaatgaaagttgagtgggattcacatagcctgcagtcttcatgatttccacatggaaagagagaattggagctagcatttaaacactaacatac

SEQ ID NO: 8950 - DNA, 579 bp, Homo sapiens
  ENST00000512631
acatggccttgtaataccctgcagtggaggatgggaaatgtagtctagctgagtgtcccagcagaaggagagaatggattttgatgatcatctagcagtttctaccacatgaacccttgactttgcttaaaaattgaggttgtggagactaatttggttgcttttgactgtcactggatcattataaatgaggaaataaacgatgtggacgtacaggaacttgtaagaaggtcaattggaaggttaacgattattcggcagacatttccagttccccagaacataagtcagcggtgtttccgtggcaaccatcgaatatcttcaacattgtgtgatccaaaggatccatttgctcagaatatggagatttccaacctttacatatatgacacggtgcttctgcttgctaatgcttttcataagaagctggaggaccgaaagtggcacagcatggcaagtctgtcatgtatcagaaagaactcaaagccctggcagggtgggcgctccatgttggagaccatcaagaagggtggagttagtgggttgactggagagctagaatttggagaaaatggaggc

SEQ ID NO: 8951 - DNA, 443 bp, Homo sapiens
  ENST00000513976
ggtggagttagtgggttgactggagagctagaatttggagaaaatggaggcaatcccaatgtccactttgaaatccttggaaccaactatggagaagagcttggcagaggtgttcgaaaaaatgaaagaatcagaccacagggctctactgggaaaatctggccccaggtaaacttcattttcaagtaatttgaccattcatatacattcatcttctgtacacttgcaaagtttgccaaactaaagcacagcagaacaacaacaaaatgttctttccctgaaacagagagagcccaggctaagccagagataacaaggagttgagactaccaaaagaatgctgacttctaaaggttgggctaagagaagagcttttatgtttaggtagaaacaggatgctgattttaaaaaaacttcttcattcattaaacattttccagatg

SEQ ID NO: 8952 - DNA, 3664 bp, Homo sapiens
  ENST00000637838
atggtgacatggacatcctgaagcacaaatggtggcctaagaatggccagtgtgacctgtactcgtcagtggacacaaagcagaaaggaggcgccctggacataaagagctttgcaggggtcttttgtatcctggctgctggaattgtcctctcctgcttcatagccatgctggagacgtggtggaacaagaggaaaggctcccgggttccatcaaaagaggcttcatccctgcagaatgaaactacaatatctgaaagaaggaatgcttggccattaaggccatgtttgaaacttggcagcaatacctggagaagccaggcatccagtcatagcctgcaccaatcatcacaaatgggaggacccctggatgacccataacctctaccagcacaagaactgctgatctgttttccaccttattgatttcaggacccattagatcctgtattcaaaactggtgagctaatgtattatctcctaaattaaaaactcctatccagttcaaggaagctgacctcaccagattgtgacacacagaaatccttgctgtaatccactcatagaagagtaacgacaggactgctgctttcagccacaggtcatggatcttgcctgcgccagcccattagccttagaaggatgcttctatgcagtggacttcttgcctagatgtcctggtcaagagcactcacactgaggtccaagtctataccacagtagctttgtcctcagcttctatctgtgcacgattttaaactctgggtcttaggacttctcatagccagagatctagggagacatgaaggaccaaggagaatggcagaacttaaccagaaaaagacagacggctcttctaatgcttattgaatcactggtaactgtggttaaacatctttggaggttttatcacagaattctctccatatttctagaacaacattatttcatacttaccaaaattggctactttcctccacaccaagggacattacctttttccccaatggccatcaaatgtctacattttgcatggattcctggctaatgtagagcctccagtttgaatccacacttagtacatgtgtcattgtaaacaaagatcacttggatcttaggattacaccctggaattgcagtgcctgtatatactacccagcgctaagataagtttgttttccttatacccacttccacattcatttataatacctcttcaatgcaaaatgtattttacaagtaaaatagggaagcatcatatgaaatatcccagcccctcatgaactcaatcagtttttattgaggaccactatgtgccaagcactgtattacattttgggaatacaatgatgaatgagtcagaatcctttccctaagaagtttgcattccagtggggaatccagatgattaaacagcatgaagagtgctagaacaggctaacaatggccataagtattccctcatctctgttccttaagcacccagggagctcccagttgcccaagctgatgcacagatgatctattatgccaaagcaacctaaaagattaaagccaacaagcagcagtccaggaggagcctctacaagtagtgatcccatgggttcttttactaatatattatttctaaataatctgactttcaaacaagttaggtgttcacttactgagcaccttcttcattatgtcatcaaactgataaccctcaagttgtagctgctcacaggtgaaaatcaggctataaagtcaaaagacagagcttcaagtttgggtcttggtgcttaccatgactgtgggcaaatcacctactttctggtctttggtgtcattctttgcaaaataaaagtaaaaacattatatactgtacctacctcacagggttgttgtgagaatcaagtgaaaagtatgtgaaagaactttgtaaactttgttatttttaatcaccccatttccatgggttcttcatcttctctacgtaatacaatactataattcacctgaaggatgtactcttacccactctgttcctacctctcacccttacacaagtgaattgtacaaagaagatgaagtacatgccttcctggatatctagtttcagatggaaattctgatacctcacagaatgacaaagaagtagtccggaggaccaaaaccggggctctactgccatagagacattccaccattaacataccactggacctggatatcagccagccctcttgatggacagttgtccacagagaacccattcttggccccagagaactactgcagtggttcagggaatcatctgggttctttctggctgccaggggagtcaccagccattccaggaaagcgcatgcttccgaaaataaagcaagaagattggttaaaggagacactgaccccattaaacaaaatacaagccttccctgactgcctgacctgtgataattgggctgccaagggagatacctagacacttatttaaagcaaggatttggtgacacatttcttcatttagcagtttatccctgatgccaacctgactcttacttctctgatttttgatttgtcgactccctgtctgtctaacagacctatgataagatgtgtttctggctttaaaatcccatatgctccccttacatacacacaaacacacaaacatccacacaatgaggaatgccagcatttttcctatctatcttacccacttgaccaagcttagcctggccttccatttctgattatttcatatggattctgattggctgatccaatttgagttcagtctcactggaccagtcgtaatgtattccaggctgaaactctgactccctttcagtcctgtgtagaagcttagagtgcccatgaagccacgataccgatacccagcaatcctttaaacaaagggaggtctttcaacttagaatacacatgcttatccaaaactaaggccgtattagcatgtatctccaggaataacataaagtttctataaaagttctcctgagcgaatagaatggtgactatgtacaaaagatctgatagaattggcatccaagaaactttgtaataaggtcttaagcctaaaatagaaaatttcaactacaattcattcttcagcttcctagagcaaggaaggcagatcacagggaaaaatcgattcattgtttatatcagtttccaaaatattttcaaatggaatggaaaataattcacaatttccttcttgctataagtcagaatggctgacttcacacaccaattcagtgaactaagaaattccaagactttttcctatggctataatattaaaagttaattttaatacctaaaaaacattagcaattaaaaacagtgtcttatattgtagtttacaaccaccacttgctgtgggaagggagccagagagactcagagtacccgccacccaaggtcaaaggcactgagccaaaggatccagcaaagagcaggcccaagccaggaagaaaagctgttgctgaaatgtcagaccaagcatatgaaacaagatgatctccaggtcatggtagctgagaaaggagaatagacagatccaagctgggaaccaaattaagatgttggaacaggtaccagagtgaataagactgggcaggggatggagtcacctacggccacacgtttgtcgtaca

SEQ ID NO: 8953 - DNA, 4844 bp, Homo sapiens
  ENST00000611049
ttcttgcagcctgtgaacttatgaatcaaggcatcttggccctggtcagctccattggctgcacgtcagcaggatccctccagtctttggcagacgccatgcatatcccccacctcttcattcagcgctcaacagctgggaccccaaggagtggctgtggactcacccggagcaacaggaatgatgactacactctctcagttcgcccacctgtctacttgcatgatgttatcctaagagtggtcacagagtatgcctggcagaaattcattatattctatgatagtgaatacgatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgaggttgtggagactaatttggttgcttttgactgtcactggatcattataaatgaggaaataaacgatgtggacgtacaggaacttgtaagaaggtcaattggaaggttaacgattattcggcagacatttccagttccccagaacataagtcagcggtgtttccgtggcaaccatcgaatatcttcaacattgtgtgatccaaaggatccatttgctcagaatatggagatttccaacctttacatatatgacacggtgcttctgcttgctaatgcttttcataagaagctggaggaccgaaagtggcacagcatggcaagtctgtcatgtatcagaaagaactcaaagccctggcagggtgggcgctccatgttggagaccatcaagaagggtggagttagtgggttgactggagagctagaatttggagaaaatggaggcaatcccaatgtccactttgaaatccttggaaccaactatggagaagagcttggcagaggtgttcgaaaacttggttgctggaatcctgtcacaggtctgaatgggtcactgactgacaagaaattggagaataacatgcgtggagtggttctacgtgtagtaactgttctggaagaaccttttgtgatggtctctgaaaatgtcttgggtaagccgaagaaataccagggcttctccattgatgttttggatgccttatctaactacctgggttttaactacgaaatttacgtagcaccggatcacaaatacggaagcccacaagaagatgggacatggaatggcttggtaggagaacttgtctttaagagagccgacatagggatttctgctttaaccatcactccagatcgtgaaaatgtggtggactttacgacacgttacatggactactcagtgggggtactacttcgaagggctgaaaagacagtggatatgtttgcctgtcttgcaccatttgatctctctctatgggcttgcattgctggcacagtccttctggtgggtctactggtctacctcttgaactggcttaatcccccacgattacaaatgggatcaatgacgtctactactctctacaactccatgtggtttgtgtatggatcttttgtacaacaaggcggggaagtcccgtacacgactctggctacccgaatgatgatgggggcttggtggctatttgctttgattgttatctcatcttacacggcaaacctcgctgctttcctcactattacacgcattgaaagttccatccagtctctccaggacctttccaagcaaacagaaatcccttatggcacagtcctagactctgcggtatatgagcatgtccgcatgaaaggactgaatccttttgagagggacagcatgtattcccaaatgtggcggatgatcaaccgaagcaatggatcggagaacaatgttctggagtcccaggcaggcattcaaaaggtaaaatatggaaattatgctttcgtatgggatgcagctgtattggaatatgtggctatcaatgacccagattgttccttttacaccattggaaatactgttgctgatcggggatatggaattgcattacaacatggcagtccttaccgagatgttttttcacaaaggatcctggagcttcagcagaatggtgacatggacatcctgaagcacaaatggtggcctaagaatggccagtgtgacctgtactcgtcagtggacacaaagcagaaaggaggcgccctggacataaagagctttgcaggggtcttttgtatcctggctgctggaattgtcctctcctgcttcatagccatgctggagacgtggtggaacaagaggaaaggctcccgggttccatcaaaagaggatgacaaggaaattgacctggagcacctccatagacgtgtaaatagcttgtgcacagatgacgacagcccccataaacagttttccacctcgtcaattgatttgacccctctggacattgacactttgccaacacgacaagcactggagcaaatcagtgatttcaggaacactcatattaccacaacaacctttatcccagagcagatccagactcttagccgcacactgtcagctaaagctgcttctggtttcacttttggcaacgtgcctgagcaccgaactggcccttttaggcacagggcacctaatgggggctttttcaggagtcctataaaaacaatgtcatctattccttatcaaccaactcctaccctggggctcaatctgggtaatgatccagaccgaggcacctccatatgagcatcaaacaaatctcttcactgtttcttttttaggactccctttgcaaggagcaactgtaatattgtgggactaacatggatgtaacgtttaaaaaaaagatcaggattattagtaacaattctagttttttcctcccaccttctccctctcctctctcctctatgattttctctctttccccctcccttcctgtacattttcctccactttttttcattactcaacttgttccccaagaaggtagtgtactaggatcctattagtctgcttttcatatactgtacatcaagtataggaaatgtgcactgagtatactaaaagtatatgcaggattaattttacataaaggcctcttctgtaacatttctctattttttgaaatacaattgcaataacttcagtctttttacattcttctgctgcatccatacaatgctccactgctgttgagtgtcctttaactgtggaccaaaggcaacccctgcagtgtttataaaacaattttaagaccattcaggccacataagatgagaatgcaattttgtaggattacaaaaaagccattaatatgccagtcaagactacagttaaaactactcttgcactgcaacagtgcatatgacctttatgtgattgtacagtattaaaagttttttcttatgtacagtaaactttatcatatggcagaagcctctattgtgttaaataaattagtatttcatatatatacatatatatgcacctatataatgtgtatatatataaaaaggcagccattgctattgcaattcatttaataaagctttagtttaaacaaaagtattgtatacaggaactatgtatagtgcaggggttcttttcagttagaaaaggcaggttgctttaatgttattctgactcgcattgtttgccaacagaaaatattttatacttttgttattaaagcatccagggcaatttaatatttgttcctagatgtaactcatttgaataggttttgcatttgttattcagcagtgtataaagctaaccttgataattttacttttaattaattatctaaatgaaaaatgctattagctgaaccacatccacaacagcacatagagctctagaagagttgaaacatagatcattgaaggttaaaaatcctcttccaaagcagcaagtcaatcaatacaataatgatatttggggaggggtgggagcccttaagaactattgatgtggccttaaattactgtcatttattatcctaaagaagaaaacataataaccataatgggctctcaactcaactcccttttttatttagttctatttggaggagttatgtattttttacattagtgccaagtatatagaaggatgacagcaaaaacagtgcctctttgtgcacaatccttttaaagtagcattcttacttgttagaaatgtagaatgaactttgtttgtaatccttaaattaaaatgtggtaagtaggaagcaagaacttattctgtgtttttacgcagccatacacttactttaatctaactcattctgtggctaggattgatataggaatcaacctatgtgatttgctttaggagaaattaaaaggtatattcttaagatatattatattttgatgctaattctgttctggggagcatcttgtattgtcactgttttgtactaaatcttcaaatattgtctactgtgtaaggcagaaaaatttcttatcatgcaaaaaccattttgtttccagggtaacaagtaactaagtgcatgcacaacttgttttcccttgtaacattcatgatctcatttacaactctgattttaaaacaaaaaaatctttacaacaagctatatagggacataccagatgttgcagtgattttagctatcaacaaactgttaaccatgtacaatatttaaaataggcttattttgatgtatcgcctattatacaaacacacaaaacatttttggaggcctcagttatgagtgacagagctttctgtgtataatttgtctaaataatttgtctaataaaaatgttttct

SEQ ID NO: 8954 - DNA, 3428 bp, Homo sapiens
  ENST00000452113
cagctctcggctctgcagcggagcataggcgaccaccaccgaaagaggccaccatgagctgcctggggatcttcatccccaagaagcaccgggcgcgcttcgacgaggtggtgtctcagggcctcctgggcaagctgtgccgcgcacgccgggcccagggcgcgcagcgactgcgccggagccgcagcgaggagcggccggagcgcctcctggtgtccacgcgcgccagcgccccgccgcgccgccccgatgagccgcccccgcgcagggcctccttgctggtgggcggcctcgccggccccgggggcgcgcgcaggactgtccgagtctacaaaggcaacaagagcttcggcttcacacttcgcggccacgggcctgtctggatcgagtctgtcctgcctgggagcccagctgacaatgctgccctcaagtcaggtgaccggatcctcttcctcaatggactggacatgaggaactgctcccacgacaaggtggtgtccatgctgcagggcagtggtgccatgcccacgctggtggtggaggaagggctcgtcccatttgccagtgactccgattctctggactcacccaacccgtcgtcggcgctcacctccctgcagtgggtggcggagatcctgccgtccagcatccgggtccaagggaggaccttcagccagcagctggagcacctactcacacctcctgagcgctatggggtctgccgggccctcgagagcttcttccagcacaggaacatcgacaccctcatcgttgacgtctaccctgtgctggacacccctgccaagcaggtcctgtggcagttcatctaccagctgctgacctatgaggagcaggagctctgtcaggagaaaatcgcatgcttcctgggctacacggccatgacagagccggagcctgagctggacctggagtccgagcccacgcctgagccccagccgcggagctccctgcgggcttcctccatgtgccgccgcagcctccggtcccagggcctggaggccggcctcagctgcggtcccagcgagtgccctgagatgcctcttcccctgatcccaggcgagcgccaggcaggcgacggcacgtccctccctgagacccccaaccccaagatgatgtcagccgtctatgcagagcttgagtctcgactgaacagcagcttcaaagggaagatggggaccgtgtccaaatcccgggcttcccctccaggccccagcccagcagtcaccacagggcccaggaccctgtccggcgtctcatggcccagcgagcgactcttgccctccccctgctaccacccgctgtgttcggggggtctggcctcccccagcagctctgagtcccacccctacgccagcctggacagcagcagggcaccctccccacagccaggccccgggcccatctgccccgacagccccccaagcccggaccccacccgcccgcccagccgcaggaagctcttcaccttctcccaccctgtgcgaagccgcgatactgaccgcttcctggacgtgctgagcgagcagctgggcccccgggtcaccatcgtggatgatttcctgaccccggagaacgactacgaggagatgagcttccatgatgaccagggcagcttcgtaaccaatgagcggagcagcgccagcgactgcatcagcagcagtgaagaaggcagctccctgacctactcctccatctctgaccacatccccccacccccgctcagccccccaccaccgccacccctgcctttccatgacgctaagcccagctcccgcagctctgatggttcccggggccctgctcaggcgctggccaagcccctcacccaactcagccacccagtccctccaccacccccaccgcccctgcccccacccgtgccctgtgcaccccccatgctgtcccggggcctgggccaccggcgcagtgagaccagccacatgagcgtcaagcgcttgcggtgggaacaggtggagaactcagaaggcaccatctggggtcagctcggggaagactctgactacgataagctgagtgacatggtgaaatacctcgacctggagctccacttcggcacccagaaacctgctaaaccggtgccggggccggagcccttccggaagaaggaggtggtggagatcctgtcccataagaaggcctacaacacctccatcctcttggcacacctgaagctgagccccgcggagctgcgccaggtgctgatgagcatggagccccggcgcctggagcccgcacatctcgcgcagctgctgctcttcgcgcccgacgccgacgaggagcagcgctaccaggccttccgcgaggcgcccggccgcctcagcgagccggaccagttcgtcctgcagatgctgtcagttcccgaatacaagacacgcctgcgcagcctccacttccaggccaccctccaggagaagacagaggagatccgaggcagccttgaatgcttgcgccaggcctccctggagctcaaaaacagtcggaagctcgccaagatcctggagtttgtgttggccatgggcaactatctcaacgatggacagcccaaaaccaacaagactacgggcttcaagatcaactttctgacagagctgaactccaccaagacagtggatgggaagtccaccttcctgcacatccttgccaaatcgctgagccagcacttccctgaactcctgggctttgctcaggacctgcccaccgtgcccctggctgccaaagtgaaccaacgggccctgaccagtgacctggctgacctccatggcactatcagcgagatacaggatgcctgccagagcatttccccctctagcgaggacaagtttgcaatggtcatgtcgtccttcctggagacggcccagccagcacttcgggcgctcgacgggctgcagcgcgaggccatggaggagctgggcaaggcgctggccttctttggggaggattccaaggccaccacctctgaggctttcttcggcatctttgcagagttcatgagcaaattcgagcgagcgctgagtgacctgcaggccggggagggcctgcgcagctccgggatggtttcacccctggcctggtgacagtggccacaccgcgtcctctgcggcctgagcagggagatggaggccgagagggcagcccagacactgccgaggtccggggccactgtgccccgggctctgagcacaccgccagcctctcctgcagctacctcagccgccgagctgtggtcgggccctcctctgccagcccttgttcctacccccaggcccagagccagatgctgtaggagcaggtgctgagtgtgcctgcacatggaggaccgtgctctgtcggcttcttgggcccacttcccacttcgctcccaggctgtcaggggggcctggagggtg

SEQ ID NO: 8955 - DNA, 3215 bp, Homo sapiens
  ENST00000435185
ggagtcgcggcgcgctcgctccattcctgggctcggctaccccctgcccttcggcacctgccgcgccgcggtccccggctccagatggggaaggaccagggcttctctcggcactttcggatcttcatccccaagaagcaccgggcgcgcttcgacgaggtggtgtctcagggcctcctgggcaagctgtgccgcgcacgccgggcccagggcgcgcagcgactgcgccggagccgcagcgaggagcggccggagcgcctcctggtgtccacgcgcgccagcgccccgccgcgccgccccgatgagccgcccccgcgcagggcctccttgctggtgggcggcctcgccggccccgggggcgcgcgcaggactgtccgagtctacaaaggcaacaagagcttcggcttcacacttcgcggccacgggcctgtctggatcgagtctgtcctgcctgggagcccagctgacaatgctgccctcaagtcaggtgaccggatcctcttcctcaatggactggacatgaggaactgctcccacgacaaggtggtgtccatgctgcagggcagtggtgccatgcccacgctggtggtggaggaagggctcgtcccatttgccagtgactccgattctctggactcacccaacccgtcgtcggcgctcacctccctgcagtgggtggcggagatcctgccgtccagcatccgggtccaagggaggaccttcagccagcagctggagcacctactcacacctcctgagcgctatggggtctgccgggccctcgagagcttcttccagcacaggaacatcgacaccctcatcgttgacgtctaccctgtgctggacacccctgccaagcaggtcctgtggcagttcatctaccagctgctgacctatgaggagcaggagctctgtcaggagaaaatcgcatgcttcctgggctacacggccatgacagagccggagcctgagctggacctggagtccgagcccacgcctgagccccagccgcggagctccctgcgggcttcctccatgtgccgccgcagcctccggtcccagggcctggaggccggcctcagctgcggtcccagcgagtgccctgagatgcctcttcccctgatcccaggcgagcgccaggcaggcgacggcacgtccctccctgagacccccaaccccaagatgatgtcagccgtctatgcagagcttgagtctcgactgaacagcagcttcaaagggaagatggggaccgtgtccaaatcccgggcttcccctccaggccccagcccagcagtcaccacagggcccaggaccctgtccggcgtctcatggcccagcgagcgactcttgccctccccctgctaccacccgctgtgttcggggggtctggcctcccccagcagctctgagtcccacccctacgccagcctggacagcagcagggcaccctccccacagccaggccccgggcccatctgccccgacagccccccaagcccggaccccacccgcccgcccagccgcaggaagctcttcaccttctcccaccctgtgcgaagccgcgatactgaccgcttcctggacgtgctgagcgagcagctgggcccccgggtcaccatcgtggatgatttcctgaccccggagaacgactacgaggagatgagcttccatgatgaccagggcagcttcgtaaccaatgagcggagcagcgccagcgactgcatcagcagcagtgaagaaggcagctccctgacctactcctccatctctgaccacatccccccacccccgctcagccccccaccaccgccacccctgcctttccatgacgctaagcccagctcccgcagctctgatggttcccggggccctgctcaggcgctggccaagcccctcacccaactcagccacccagtccctccaccacccccaccgcccctgcccccacccgtgccctgtgcaccccccatgctgtcccggggcctgggccaccggcgcagtgagaccagccacatgagcgtcaagcgcttgcggtgggaacaggtggagaactcagaaggcaccatctggggtcagctcggggaagactctgactacgataagctgagtgacatggtgaaatacctcgacctggagctccacttcggcacccagaaacctgctaaaccggtgccggggccggagcccttccggaagaaggaggtggtggagatcctgtcccataagaaggcctacaacacctccatcctcttggcacacctgaagctgagccccgcggagctgcgccaggtgctgatgagcatggagccccggcgcctggagcccgcacatctcgcgcagctgctgctcttcgcgcccgacgccgacgaggagcagcgctaccaggccttccgcgaggcgcccggccgcctcagcgagccggaccagttcgtcctgcagatgctgtcagttcccgaatacaagacacgcctgcgcagcctccacttccaggccaccctccaggagaagacagaggagatccgaggcagccttgaatgcttgcgccaggcctccctggagctcaaaaacagtcggaagctcgccaagatcctggagtttgtgttggccatgggcaactatctcaacgatggacagcccaaaaccaacaagactacgggcttcaagatcaactttctgacagagctgaactccaccaagacagtggatgggaagtccaccttcctgcacatccttgccaaatcgctgagccagcacttccctgaactcctgggctttgctcaggacctgcccaccgtgcccctggctgccaaagtgaaccaacgggccctgaccagtgacctggctgacctccatggcactatcagcgagatacaggatgcctgccagagcatttccccctctagcgaggacaagtttgcaatggtcatgtcgtccttcctggagacggcccagccagcacttcgggcgctcgacgggctgcagcgcgaggccatggaggagctgggcaaggcgctggccttctttggggaggattccaaggccaccacctctgaggctttcttcggcatctttgcagagttcatgagcaaattcgagcgagcgctgagtgacctgcaggccggggagggcctgcgcagctccgggatggtttcacccctggcctggtgacagtggccacaccgcgtcctctgcggcctgagcagggagatggaggc

SEQ ID NO: 8956 - DNA, 3636 bp, Homo sapiens
  ENST00000457091
atggccaccactgccacgccggccacgaaccagggctggccagaggactttggcttccggctaggtggctctggcccctgcttcgtcctggaggtggccaaggggagcagcgcgcatgccggaggactgcggccaggagaccagatcctggaggtggaggggctggcggtgggcggtctgagccgcgagcgcctcgtgcgcctggcacggcgctgcccacgtgtgccgcccagtctgggcgtgctcccggctcccgacggtggccccggcccaggatccggccccgcggccccgaccacagtcttgcgggccccgcggtgcggccgcggcctagctctgggccgtgagctgcttcgcctggccggccgcaagcgcccggacgcggtgcaccgagagcgcaggcgcaaggcccaagagttcagccgcaaggtggatgaaatcttgggggaccagccaactgccaaggagcaggtgttcgctgcactgaagcagtttgcagctgagcagcgggtggatgatctggtgtggactctcaccctggcgctgccccgagaggcctgcgggccactcctggacaacctcaggatcttcatccccaagaagcaccgggcgcgcttcgacgaggtggtgtctcagggcctcctgggcaagctgtgccgcgcacgccgggcccagggcgcgcagcgactgcgccggagccgcagcgaggagcggccggagcgcctcctggtgtccacgcgcgccagcgccccgccgcgccgccccgatgagccgcccccgcgcagggcctccttgctggtgggcggcctcgccggccccgggggcgcgcgcaggactgtccgagtctacaaaggcaacaagagcttcggcttcacacttcgcggccacgggcctgtctggatcgagtctgtcctgcctgggagcccagctgacaatgctgccctcaagtcaggtgaccggatcctcttcctcaatggactggacatgaggaactgctcccacgacaaggtggtgtccatgctgcagggcagtggtgccatgcccacgctggtggtggaggaagggctcgtcccatttgccagtgactccgattctctggactcacccaacccgtcgtcggcgctcacctccctgcagtgggtggcggagatcctgccgtccagcatccgggtccaagggaggaccttcagccagcagctggagcacctactcacacctcctgagcgctatggggtctgccgggccctcgagagcttcttccagcacaggaacatcgacaccctcatcgttgacgtctaccctgtgctggacacccctgccaagcaggtcctgtggcagttcatctaccagctgctgacctatgaggagcaggagctctgtcaggagaaaatcgcatgcttcctgggctacacggccatgacagcagagccggagcctgagctggacctggagtccgagcccacgcctgagccccagccgcggagctccctgcgggcttcctccatgtgccgccgcagcctccggtcccagggcctggaggccggcctcagctgcggtcccagcgagtgccctgagatgcctcttcccctgatcccaggcgagcgccaggcaggcgacggcacgtccctccctgagacccccaaccccaagatgatgtcagccgtctatgcagagcttgagtctcgactgaacagcagcttcaaagggaagatggggaccgtgtccaaatcccgggcttcccctccaggccccagcccagcagtcaccacagggcccaggaccctgtccggcgtctcatggcccagcgagcgactcttgccctccccctgctaccacccgctgtgttcggggggtctggcctcccccagcagctctgagtcccacccctacgccagcctggacagcagcagggcaccctccccacagccaggccccgggcccatctgccccgacagccccccaagcccggaccccacccgcccgcccagccgcaggaagctcttcaccttctcccaccctgtgcgaagccgcgatactgaccgcttcctggacgtgctgagcgagcagctgggcccccgggtcaccatcgtggatgatttcctgaccccggagaacgactacgaggagatgagcttccatgatgaccagggcagcttcgtaaccaatgagcggagcagcgccagcgactgcatcagcagcagtgaagaaggcagctccctgacctactcctccatctctgaccacatccccccacccccgctcagccccccaccaccgccacccctgcctttccatgacgctaagcccagctcccgcagctctgatggttcccggggccctgctcaggcgctggccaagcccctcacccaactcagccacccagtccctccaccacccccaccgcccctgcccccacccgtgccctgtgcaccccccatgctgtcccggggcctgggccaccggcgcagtgagaccagccacatgagcgtcaagcgcttgcggtgggaacaggtggagaactcagaaggcaccatctggggtcagctcggggaagactctgactacgataagctgagtgacatggtgaaatacctcgacctggagctccacttcggcacccagaaacctgctaaaccggtgccggggccggagcccttccggaagaaggaggtggtggagatcctgtcccataagaaggcctacaacacctccatcctcttggcacacctgaagctgagccccgcggagctgcgccaggtgctgatgagcatggagccccggcgcctggagcccgcacatctcgcgcagctgctgctcttcgcgcccgacgccgacgaggagcagcgctaccaggccttccgcgaggcgcccggccgcctcagcgagccggaccagttcgtcctgcagatgctgtcagttcccgaatacaagacacgcctgcgcagcctccacttccaggccaccctccaggagaagacagaggagatccgaggcagccttgaatgcttgcgccaggcctccctggagctcaaaaacagtcggaagctcgccaagatcctggagtttgtgttggccatgggcaactatctcaacgatggacagcccaaaaccaacaagactacgggcttcaagatcaactttctgacagagctgaactccaccaagacagtggatgggaagtccaccttcctgcacatccttgccaaatcgctgagccagcacttccctgaactcctgggctttgctcaggacctgcccaccgtgcccctggctgccaaagtgaaccaacgggccctgaccagtgacctggctgacctccatggcactatcagcgagatacaggatgcctgccagagcatttccccctctagcgaggacaagtttgcaatggtcatgtcgtccttcctggagacggcccagccagcacttcgggcgctcgacgggctgcagcgcgaggccatggaggagctgggcaaggcgctggccttctttggggaggattccaaggccaccacctctgaggctttcttcggcatctttgcagagttcatgagcaaattcgagcgagcgctgagtgacctgcaggccggggagggcctgcgcagctccgggatggtttcacccctggcctggtga

SEQ ID NO: 8957 - DNA, 3179 bp, Homo sapiens
  ENST00000327783
tgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagaaaggaaagtcatcaagaattagattttattttaggaacaaagtaaggtttcatgggagaaaaaaacaaagccttggtgtagagaagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccagaa

SEQ ID NO: 8958 - DNA, 3140 bp, Homo sapiens
  ENST00000389125
agcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccagaa

SEQ ID NO: 8959 - DNA, 3234 bp, Homo sapiens
  ENST00000399913
agccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccagaa

SEQ ID NO: 8960 - DNA, 3624 bp, Homo sapiens
  ENST00000399914
agaagccggaacgtggctccgctcccagttaacctgctggagctcatcaggcttgctcagagcccctgcaccaactcaccctgtaccctctctccttcttcgttagtcttctttcccccttttccctcctctgtctgtgcctatcccccgacttttgcatctgaccaaaggacgaatgagggagacgttcctgcagatcggggcagcaactttcctcagctggtctctgggctccgggagccagagagcgctgatcctccgcggtctgcggcccatggaagaggaggaggaggagccgtgatgggctagcgacagcactgaggagccccgagagagctcagccttgccagccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagaaaggaaagtcatcaagaattagattttattttaggaacaaagtaaggtttcatgggagaaaaaaacaaagccttggtgtagagaagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccagaa

SEQ ID NO: 8961 - DNA, 2712 bp, Homo sapiens
  ENST00000389124
tgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagcattactgaagtgtccgtatgccttgataatcctatcaatgtttggatcatctcagtgggggaaatgacttaa

SEQ ID NO: 8962 - DNA, 3472 bp, Homo sapiens
  ENST00000399907
ctttcccccttttccctcctctgtctgtgcctatcccccgacttttgcatctgaccaaaggacgaatgagggagacgttcctgcagatcggggcagcaactttcctcagctggtctctgggctccgggagccagagagcgctgatcctccgcggtctgcggcccatggaagaggaggaggaggagccgtgatgggctagcgacagcactgaggagccccgagagagctcagccttgccagccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacaggctttttgtttcttttatggactgcaatgtaagcaaacccatccaaccaactccacttctggaactactttatctacggatttagaatgtggtaaattaattcgagaggagagagggattcgaaaacagtcctcagttcatactgtgtaatcagtttaaaaaaaaaaaaaaagatgtgcccagtagaaaatgtttttgctaattggtgttgttgatatttgtatttgctaagcataaatagccacaattctctattcctttaggatagcaaaactcatgtattctagacattgaaatgaatacactggaaagatacttgcactgtatgttgaagcaggggcatattaggggtataaagacttctagaaatgtgtatttacaggaatcttctctgtcccactcatcatcttagttctatcttcatgcattaaaaataagtaactcttccttcat

SEQ ID NO: 8963 - DNA, 3427 bp, Homo sapiens
  ENST00000399909
ctttcccccttttccctcctctgtctgtgcctatcccccgacttttgcatctgaccaaaggacgaatgagggagacgttcctgcagatcggggcagcaactttcctcagctggtctctgggctccgggagccagagagcgctgatcctccgcggtctgcggcccatggaagaggaggaggaggagccgtgatgggctagcgacagcactgaggagccccgagagagctcagccttgccagccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacaggctttttgtttcttttatggactgcaatgtaagcaaacccatccaaccaactccacttctggaactactttatctacggatttagaatgtggtaaattaattcgagaggagagagggattcgaaaacagtcctcagttcatactgtgtaatcagtttaaaaaaaaaaaaaaagatgtgcccagtagaaaatgtttttgctaattggtgttgttgatatttgtatttgctaagcataaatagccacaattctctattcctttaggatagcaaaactcatgtattctagacattgaaatgaatacactggaaagatacttgcactgtatgttgaagcaggggcatattaggggtataaagacttctagaaatgtgtatttacaggaatcttctctgtcccactcatcatcttagttctatcttcatgcattaaaaataagtaactcttccttcat

SEQ ID NO: 8964 - DNA, 1775 bp, Homo sapiens
  ENST00000472429
caaagattcagagaagccggaacgtggctccgctcccagttaacctgctggagctcatcaggcttgctcagagcccctgcaccaactcaccctgtaccctctctccttcttcgttagtcttctttcccccttttccctcctctgtctgtgcctatcccccgacttttgcatctgaccaaaggacgaatgagggagacgttcctgcagatcggggcagcaactttcctcagctggtctctgggctccgggagccagagagcgctgatcctccgcggtctgcggcccatggaagaggaggaggaggagccgtgatgggctagcgacagcactgaggagccccgagagagctcagccttgccagccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaaggtaacctccttaacaataaataaataaaataacaaa

SEQ ID NO: 8965 - DNA, 4789 bp, Homo sapiens
  ENST00000421544
ggagagcagctatctcagtctttctcacttaatcttggcttcacgtcagaagctgtgcagcagtgcagtagaatagggcctggcaaaacctttgctagcaaagcgccttttgtgccgggctgtggctcgctatcgacatctcgtccgttaccaaggctgggtttcctactgatttccctcctcctctgctttcacaggctcgcgcggccggacattgtgggtgtgcgtgctggatttctcccggatgctctccgactaacatggatgtcccaccattccttgcagtggaaggttgttccttggcgcagtgagtgaagaacatgcagcgattgctaatgggtttgggaagcggagactccttcctctctctatgaccatgccgtgatcgtgtctgcggtcaccactcgacgcatcctcatttctacccgaacccaggagccgaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaagaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 8966 - DNA, 4876 bp, Homo sapiens
  ENST00000413795
ggagagcagctatctcagtctttctcacttaatcttggcttcacgtcagaagctgtgcagcagtgcagtagaatagggcctggcaaaacctttgctagcaaagcgccttttgtgccgggctgtggctcgctatcgacatctcgtccgttaccaaggctgggtttcctactgatttccctcctcctctgctttcacaggctcgcgcggccggacattgtgggtgtgcgtgctggatttctcccggatgctctccgactaacatggatgtcccaccattccttgcagtggaaggttgttccttggcgcagtgagtgaagaacatgcagcgattgctaatgggtttgggaagcggagactccttcctctctctatgaccatgccgtgatcgtgtctgcggtcaccactcgacgcatcctcatttctacccgaacccaggagccgaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaaggaatcttctatttggttagtgccaccataccatccagacactgtttagtaatcttttgaaacttactaaaagaggtttttaataatgaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 8967 - DNA, 4921 bp, Homo sapiens
  ENST00000369138
ggagagcagctatctcagtctttctcacttaatcttggcttcacgtcagaagctgtgcagcagtgcagtagaatagggcctggcaaaacctttgctagcaaagcgccttttgtgccgggctgtggctcgctatcgacatctcgtccgttaccaaggctgggtttcctactgatttccctcctcctctgctttcacaggctcgcgcggccggacattgtgggtgtgcgtgctggatttctcccggatgctctccgactaacatggatgtcccaccattccttgcagtggaaggttgttccttggcgcagtgagtgaagaacatgcagcgattgctaatgggtttgggaagcggagactccttcctctctctatgaccatgccgtgatcgtgtctgcggtcaccactcgacgcatcctcatttctacccgaacccaggagccgaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaagagagccaagactaagttacctcaagactatgtattcctccctattttggagtcagtttccatttctacagtgttgtcatcatcaccatcttcatcatcattatcatcatgttcttaataagtacatctaataaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 8968 - DNA, 1981 bp, Homo sapiens
  ENST00000358361
gcagctatctcagtctttctcacttaatcttggcttcacgtcagaagctgtgcagcagtgcagtagaatagggcctggcaaaacctttgctagcaaagcgccttttgtgccgggctgtggctcgctatcgacatctcgtccgttaccaaggctgggtttcctactgatttccctcctcctctgctttcacaggctcgcgcggccggacattgtgggtgtgcgtgctggatttctcccggatgctctccgactaacatggatgtcccaccattccttgcagtggaaggttgttccttggcgcagtgagtgaagaacatgcagcgattgctaatgggtttgggaagcggagactccttcctctctctatgaccatgccgtgatcgtgtctgcggtcaccactcgacgcatcctcatttctacccgaacccaggagccgaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgatggagtttcactcttgttgcccaggctggagtgcaatggcacgatctcagctcactgcaacctctgcctcctgggttcaagcgattcttctgcctcagcctcccgagtagctgagattacaggcacacaccactatgcctggctaatttttttgtatttttagtagagatggggtttctctatgttggtcaggatggtctcgaactcctgacctcaggtaatccgcccaccttggcctcccaaagtgctgggattacaggcaagagccactgcacctggcccacagtttcttaatccatttgttgattgatgggcatatgggctggttccatatgtttgcaactgcaaattgtgagcactgtttaattctaagcttccttgtaggtaaggcaaaaagcaagcaaagtattttaggcaattcccataactaaagggaaattatttattatatttgtccatttgaaaagatattttttcatgttgtaaaaaatttattaaatgaatgctaacataaggattaataaacaacatgatcttaacattc

SEQ ID NO: 8969 - DNA, 540 bp, Homo sapiens
  ENST00000455610
tgtagccatgaaatggcagcaggcattttaaaacaggcattagctatgggaatgatgacagaatactatcattatatctttaccactctgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctc

SEQ ID NO: 8970 - DNA, 1066 bp, Homo sapiens
  ENST00000436862
attggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtaacatgctcacttttgtgatttttttggcaattgttacctcctttatctaactaataattgtcaaaagtcacaatcaattttactttttctgttctttattttccatggggtgctgagaaataatgaaattttaagaatcacattcatttattaaaatgtactgtcctgtctttgtgggcagagagcatgctggttgtgtcagtaagctataagtgttatagggattactgttttcttaaccagaatataaaagctttttaaatcaatatgataaatgaatcattgcctcacttcgaagatttctgaagaaccaaaactaaaataacatgttttactaacttgagttaataattcagttataagaaaaaccaaagtactaaaatttaaaaggaggccttttttaaggaaccaagacatttataataaacattctaactataaaaggactaccttagtattctacataatatttgtggtttttttcttgttttttcacagaataaatgtcattaccaaaa

SEQ ID NO: 8971 - DNA, 1518 bp, Homo sapiens
  ENST00000487395
tttaattgatgctaaccatagtgatgggagatccttgcttatacaggagaacataatttattatcttattttaaaataaacattacactaaaaccccacatcatttcaagaaatgtgggcaatagtagttattttattattatacgtaacttttaaaaataacaagatagacaaaatgtttgagctacatgcacatgaaaagtgaaatttacaaaaagcttaagaaagggatccaaaagtatatttaagcacttcctctgaaaccctcataactaacaaaatatgaaaaaacaataaatgtggtttataaaccagaaagcctaaaaaatctcttctaatgctatttttattaaaaatgtttactcattaatattttaattggaactttgcatcatctcaggtagaacatgagtctcctgtcactatatttaaacaagaatgtcctaaaagattgtctattttctgaaaatagcctctgctttcccaatggttgttgcttgcttactaaagaaatatgtaaatctttgatttaagcttttattacacagtgattccattctgccactgtgacaaaaagtatctgattgctgatcaaattctctatattcgtttcacctttcccccactctctgttaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaagaagaaaaaaaaagaatgaggaggaataagaagaggaggaggaaggaaagaagaacagaaacacaaaatcttactgtgtcattacatgacctatgattaatctcttccatcttatttacattttggataaataggtgactctattttctcaaagtaaaaaggaagatatatttacttacttgccaattatcttattgaagtgttaaagttttatttttctctggattattttaagatgtacttactattaattcattttattgaaagttgacatggtaaactatatttccaggactatagaagattcaaagatgataaaatatgtatggccttttcttcacaggctttaaaatctaatgacaatttcataagcaaccataaatttgaacatttttgatatctgtaacaatatagtactttatgtaaatggttatagcaaaaataatgccatagttctatgaggaaagaaattttaaaattcctgattcttctcctttagaaatatgtacatatttatctatctatgcatagatactatttcttgaaatatagttaaatctattatacttccatcatattaggctatatatgcatgcttctatatatatattaatatatatgttaacatacagaataaaaataaatatatatgttctactagc

SEQ ID NO: 8972 - DNA, 691 bp, Homo sapiens
  ENST00000487161
cattaatattttaattggaactttgcatcatctcaggtagaacatgagtctcctgtcactatatttaaacaagaatgtcctaaaagattgtctattttctgaaaatagcctctgctttcccaatggttgttgcttgcttactaaagaaatatgtaaatctttgatttaagcttttattacacagtgattccattctgccactgtgacaaaaagtatctgattgctgatcaaattctctatattcgtttcacctttcccccactctctgttaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaa

SEQ ID NO: 8973 - DNA, 4185 bp, Homo sapiens
  ENST00000369134
ggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaagaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 8974 - DNA, 4317 bp, Homo sapiens
  ENST00000318991
ggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaagagagccaagactaagttacctcaagactatgtattcctccctattttggagtcagtttccatttctacagtgttgtcatcatcaccatcttcatcatcattatcatcatgttcttaataagtacatctaataaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 8975 - DNA, 4272 bp, Homo sapiens
  ENST00000369137
ggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaaggaatcttctatttggttagtgccaccataccatccagacactgtttagtaatcttttgaaacttactaaaagaggtttttaataatgaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 8976 - DNA, 9101 bp, Homo sapiens
  ENST00000373091
ctcggcggcgcccaacgatgaccgctccctggcggcgcctccggagtctggtttgggaatactgggccgggctcctcgtgtgcgccttctggatcccggactcgcgcgggatgccccacgtcatccggatcggaggaatcttcgagtatgcggacggccccaacgcccaggtcatgaatgccgaggagcatgcctttcgattttctgccaacatcatcaacaggaacaggactctgctgcccaacacaaccttgacctatgacatacagaggattcacttccatgacagcttcgaggcgaccaaaaaggcctgtgaccagctggcactgggcgtggtggcgatcttcggcccatcacagggctcctgcaccaatgccgtccagtccatctgcaatgccctggaggtgccccacatccagctgcgttggaagcaccacccgctggacaacaaggacaccttctacgtgaacctctaccccgactacgcctcgctcagccatgccatcctcgacctggtccagtacctcaagtggcggtcagccaccgtggtctatgacgacagtacagggctcatccgactgcaggagctcatcatggccccatcaagatacaacatccgcctgaagatccgtcagctccccatcgactctgacgactcgcgccccttgctcaaggagatgaagcgaggccgggaattccgcattatcttcgactgcagccacactatggcggcccagatcctcaagcaggccatggccatgggcatgatgactgagtactaccacttcatcttcaccactctggatctctacgctttagacctggagccctaccgctactcaggcgtgaacctgacaggattccggattctcaatgtggacaacccacacgtctcggccattgtggagaagtggtccatggagcggctgcaggcagctccccggtccgagtctggcctgctggatggagtgatgatgactgatgcagccttactgtacgacgccgtccatatcgtgtccgtgtgctaccagcgggcaccacagatgaccgtgaactccctgcagtgccatcggcacaaggcctggcgctttggcggccgcttcatgaacttcatcaaggaggctcaatgggaaggattaactggacgaattgttttcaacaaaactagtggcttgcggacggattttgatctggacatcatcagcctgaaagaggatggcctggagaaggttggggtgtggagtcctgccgacgggctcaacatcactgaggttgccaaaggccgaggccctaatgtcaccgactctctgacaaacagatcactcattgtcaccacagtgctggaggagcccttcgtcatgtttcggaaatcagacaggacgctatacgggaatgaccggttcgagggctactgcatcgacctgctaaaggagctggcccacatccttggtttctcctatgagatccggctggtggaggacggcaagtacggggcacaggatgacaagggccagtggaacggcatggtcaaggagctcatcgaccacaaggcagatctggccgtggcccccctgaccatcacccatgttcgagagaaggccatcgacttctccaagcccttcatgacacttggtgtgagcatcctgtatcgaaagcccaatggcaccaaccccagcgtcttctccttcctcaatcccctgtccccagacatctggatgtatgttctcctcgcctacctgggggtcagctgtgtcctcttcgtcatcgccaggttcagcccttatgagtggtacgatgctcacccctgcaaccctggctccgaggtggtggaaaataacttcactctgcttaacagcttctggtttggaatgggatccctgatgcagcaagggtctgagctgatgcccaaagccctgtccacacgcatcattggtggcatctggtggttcttcacgctcatcatcatctcttcctacacggccaacctggctgcctttctgaccgtggagcgcatggaatcacccattgactctgctgatgacctggccaagcaaaccaaaatcgagtatggggctgtcaaggatggggccaccatgaccttcttcaagaaatccaagatctccaccttcgagaagatgtgggccttcatgagcagcaagccatcggcgctggtgaagaacaacgaggagggcatccagagggccctgacggccgactacgcgctgctcatggagtccaccaccatcgagtacgtcacgcagaggaactgcaacctcacccagatcgggggcctcattgactccaagggctacggcatcggcacgcccatgggctccccataccgggacaagatcaccatcgccatcctgcagcttcaggaggaggacaagctgcatatcatgaaggagaagtggtggcggggcagcgggtgtcctgaggaggaaaacaaagaggccagtgccctggggatccagaagatcgggggcatcttcattgtcctggccgccgggctggtcctctctgtgctggtggccgtgggcgagtttgtgtacaagctccgcaaaacagcagagagagagcagcgttccttctgcagcaccgtggccgatgagatccgtttctcccttacctgccagcgtcgagtcaagcacaagcctcagcctcccatgatggtcaagactgacgccgtcatcaacatgcacacattcaatgaccgccggcttcccggcaaggacagcatggcctgcagcacatccttagcccctgtgttcccctaggcacagctggggtggggacctcaggcctgggggctgggcagaggaaagcaaaggagattggaaggaacgtcccctgtccccgcactgggcttggggaccagagctgccacctgcctgttgggccaggagcctcctgcccttacctgccaggaagccagcaggctctcaggccagctgcttgggcttcatcctcctcagatcttctgtgggtttctaaagctgccagccgagatagccaaggccaaaggaagcacatgcctctctcaggccaaactcacctgcccctcaactctcctccagagtcagaagtttctgccgcagccctgcagagggcacagaaaatggaagacagctcttatattgccatttcttccacaagagcccaggcctcctacagcttgaccgtgaggccagagacacaagccttcggcgccttaaggatgttctagcatggctgccaatgggagctcatggtgagggatacccatcccatatgcctgggcagaaggaagacttcatccctctggggctgttcacgtggtcctaatcttctgaacttggcgctgcccctggcagcccctgttctggcagagttgaagacagagctacacaggggaaaagaggagtttggggtatgggagagaagagaatgcacaaacagaggccgccattttggattcttatggacaatgacccagtggttcctaatcctctaggaggtctctaagaatataagtgggggagtggccacagaaaattcttctccactttctagccagaggagagaggaccccctgaatttctcacaaaggatgcccaaagatgcagccggtatttgaagcccagcagaggaaaagcagattccatggaagtcccaccggctcttgtgccaatggatctcactttcctggttagcaagctgttgtctaaaccctgttcacatttggaaacctgggctctttgccatcttctcatcaacaactccccattcctggctggttgaccttggcctcactctgtctttttgaaagaagagttggttgaagtgaaagtcaagttgtccctcctcaaaaaaggagttagtgtcctactacacagactaactttgggctaggtgagggaaaccagaagagaccaaaagaacttctggtctcctggacttaccaaacctagagatgctccccaggaaaagaaagtttccagggacataatatcatagctggcagaggccccaagggtggggaggaagaagctgcctcctggagaattaaccaaagaccccacacagagacatgaggccatcctggccccttgtctgttgtccagagcagctatggcattgtggggcttggggaagacagcagagaagtagcagcaggttgggtaccagccagggggtggacctatgagttccagcttgctgtgatgaatgctctagaggtctgtgactttaagagtcttggaaaagaatgagacatgaaggattaggaacaaagtgtccttaaagagaacatgatgggccagcagggttaccatggccaaggatggaggggcaggttttgaacaggggagggaggttctggggattctggatgagaactggggcataccagccactcccctcccacctctgtcccatgctgcttgggaagcccggttagggaagagcttcatttggatctcaagggctttctcatctgggtgaagggcaatctctagcaaagcaggagaccacagtgggctcatgtgataaacactgtccctcctccagactgtgagctgcaggaccaaaccagcaggttcccagaatcctagcagctctgactggctatgtacattggacgagggagaggagggctagacatacaccaaagccccatgcatgtaatgttaggaaaagccatgctgtcataagcttcagggtacagagggcgtgtgcatgtgtgtctgtgtctttgtgtttgtatgtgtgagcttcgggggctggggcacaggacagatctggacatataacatagtccagggcatgcaataataggtgaatccttggggatctgatgtgtgcatatgcgtgcgtatgtgtatctgagtgaattggggacgagggagacaaatatgtgaagcagcaaggccccatatatgtaaaaacaggagaagccatgtcataatggggccctggtgggtatgcatatgtaagcatgcatgcatgcataggtgtgtgcatgctggtgtgtgtgtgtgcacatgtacactgaatggcataggatggagatcaggatcttacctgcagctagccaaatatgcgtaaaaggagaagccatgtcaccaaggggtccatgtctgagtgcatgtgaacacatgtgtacaggcatgtgtgcacagtggggagcggggggaaggccaggaccagagagtcgtgtgacatgggtcaatgcatgctgtagacaagaagccacgtggagttgaagtttccgagtgtgtgggacacacacatatgttccaggtcacagtggaagcaaagacagacaatcaggaaggccgggcaccagggtctgtttgcacttctgtcatgggagagatcatttgtcacagagaggttccaaggttgcatgggcacacttgccaggagacgggggcacaacccttcaggggctcatgctgctgatgcctttgctgtggacatcatgtcctgtttgaagggaaaactcttttttgtaattcccaggtaacaggattctaatgaaggtatttgccaatttgctgtcagcaaacacaatcattaagcgccgtcttactttgtccagtatagtttcagagcacgtgcctcattcttgctcttgtctcacacatgtgttgtgtgtgtgatgctacatgagcatgttcttcagaggctatgcatatatgtggattgtgacaggaggaagaagaagtggtgagaatttttataaaacgaacaaagaatagtggataaatagaggcagaattcaattcgagaaaccccccaaaatgtaccgactggtctttagactcctgtgtggaagcaggagggcatgctgcctcatctcctctcccaggcaaaccttgcgtcctgatgttcaggtgttgtcggtgtggctgatatttggcttctggccaatatcctgcatttgtcctagagaccagcctagtgttcaaagtgcagtggggaccacagctgcccaagcatgagctctgtctctcccggggcactgaaaatgatgctacatctgtgaggtgggacggagtggggaggtgttttcagtgaggcagatcttgtgtttttttaagtttaggtctgtcctgccagtgggcatggagctgagctggggcaggtgcatgcgtgtgtgtgtatgtgtgtgtatgcatgtgtagtgtgtgtgcacacacgcaggcactgagaggtgatgggaagcatgaaagcttgcttggatggagcagaagaaggaacctgcctgagcagatgctggactgtccctgcgtggtgccacatgccagccctgaacagaagaatgtccccactgcatccccaaatgcaagtgcctcctctccacctgctcaagctggccaagttgaggggcagtggtaagaagacaccaaccccaccgcccctgccgaggccctgggactaaggacagtgagccctcccaatcactctccccttgtcctgctgctggtttctctgctctggacagaagaaaatcctgaaagcgttgtcaatgttcaagtggccccatgctgcaagagtctctcgcgaggggtgacgcccccttggccagtgtgctggactttgagtgtctgaggggtaagagggccaccccctcctcacagccgagactctatctaacctggaagcacactctggctccacccccaacccctgccatgccctaggccctggaagatgggaatcctggcccaggccagggtaaagggccaaacaggttagaagttgctcccctccaccaggcgtgcactcaccaagaacgatcaaaagctccctttctgcctacttttccaggggtactgggtgtggggggtgggtcacagctcctgcttcatcactcagcatgaagttggtccctccctgagccactcccagctacatgcacaaacatctgaaagtaggctggcctctctggctcacatctggagtggtcctgtgtggatacccatctgcaaaggggctagaggtttggacaaacagctgcatggacttatcatctgggatgggcccagcctcatggacagatacaagaaatgagcccaactctgtgggcaggtctctggattagacacatctgaaagttgcaggtcaagtggacacatctggaagtggcccggctgctggctgccatggaagggccgtgccctctgtccccatggcagtttaaatcaggccttcccttcagtcctggatttgccctggagtaaaaatttcagagctgaggtcatacgtgagtcacaaaacttttaggtagaaggttaatgttctgtacaatatatatatgaatgtaaaatatatatatatactgtatatatatatatatatgcacagtgtatatatgacctgtagcccatgtgtatacaaccctttcctgcacgtctgcacacggagtgtacagaacccagccagcacgggtgaggaccagatgagagatgggggctgcagcagcaaagtctgggacggaggtctcagagagccccttggggtggcgaaggccctccacacatcagagctccagaccctgaagaagagggcagagctacatggtgctgccaggtgagtcctgcaccgccagggcctcctgtgggaggggcaggaatggccaacggacctcatctccatccgagcctgtctgaggcaggacagctgggtgtgtctgagaagcaatgtcatgctagtactcagcccctgtgccaatattacattctagttctggggcaattcatcaggagcagaagggctgggaaagagcaggccactccccaggcctgttctcacacctgcctgcagaatcacaggtaggtttcaggctccatctaggataccctagaaggcggggctattctaggtagcaaaagcctctgcctctgattctcacccacatgcagaagcagtcacaacttgcacacaacacagctcacaactagggaaagcacttgttaaagagaatgcccccagggcatggccagcatgccgatacagtgttcccatgcccctgttactgatcctgtcctcctgccttctagaacagtggacctcacatcacctcccagattgtctccattttatggattgaaactctgaggcctccagacatgaagaagcagccatagattcagtcaaatgccagccaagggtttgccttgcctcagacaacctccccagccccatttgacccagagaccagctgtcagggagcgacctcagagccagaggggtgaaagatgagaggcaagaaggtagctcctatcctagcacagcccaggctccatctgtctgcctttctctcccctgcggcatcctggcagggcagttggcagagtgccccctccccaggaggctgcagatctctgtccctggctcacccagatcggtctgttctctgcagttccattcctttagcctctttcgcaggtctgagcatctctggagcatgcaggggaggagatatctgaggtgggcttccgtgcagtcagcagcctgccccagcttcagcctcaggcgtcaggctggtctgcactgaactctgggtctgcctctggggccctgaccaagcacgcctgactccagccccatgaggagcatcctgtcttggttccgtagggatcatgggtcctcttaccactgtgcgccaagcccccagcccacctctgcctgggccgacttcctggttgggcctcccatggtaggggcctcagttcccaggctctgggctgagcccccagggagcaccatgggcctctgagaccctagacctgtcccaccacccagaccagagtgcctggacgccccccactcccactcaacatggttcccacacactggtctctgggccattcaggggatgccctttgtggacatgcagaatttctatgaatatagttttttgtaaacattttgtaacaatttgggtttcatagtaactgtgttacttgccaatcattctaggctgatgtaaataaatttccaaacaaatctgattattttcctttttaagacactgtgatatatcaaagtgcacagtttgctgtatgaagtaatatggttttaaattttaaataaaatgtttctagaaaacaggg

SEQ ID NO: 8977 - DNA, 2955 bp, Homo sapiens
  ENST00000373093
cacgctcggcggcgcccaacgatgaccgctccctggcggcgcctccggagtctggtttgggaatactgggccgggctcctcgtgtgcgccttctggatcccggactcgcgcgggatgccccacgtcatccggatcggaggaatcttcgagtatgcggacggccccaacgcccaggtcatgaatgccgaggagcatgcctttcgattttctgccaacatcatcaacaggaacaggactctgctgcccaacacaaccttgacctatgacatacagaggattcacttccatgacagcttcgaggcgaccaaaaaggcctgtgaccagctggcactgggcgtggtggcgatcttcggcccatcacagggctcctgcaccaatgccgtccagtccatctgcaatgccctggaggtgccccacatccagctgcgttggaagcaccacccgctggacaacaaggacaccttctacgtgaacctctaccccgactacgcctcgctcagccatgccatcctcgacctggtccagtacctcaagtggcggtcagccaccgtggtctatgacgacagtacagggctcatccgactgcaggagctcatcatggccccatcaagatacaacatccgcctgaagatccgtcagctccccatcgactctgacgactcgcgccccttgctcaaggagatgaagcgaggccgggaattccgcattatcttcgactgcagccacactatggcggcccagatcctcaagcaggccatggccatgggcatgatgactgagtactaccacttcatcttcaccactctggatctctacgctttagacctggagccctaccgctactcaggcgtgaacctgacaggattccggattctcaatgtggacaacccacacgtctcggccattgtggagaagtggtccatggagcggctgcaggcagctccccggtccgagtctggcctgctggatggagtgatgatgactgatgcagccttactgtacgacgccgtccatatcgtgtccgtgtgctaccagcgggcaccacagatgaccgtgaactccctgcagtgccatcggcacaaggcctggcgctttggcggccgcttcatgaacttcatcaaggaggctcaatgggaaggattaactggacgaattgttttcaacaaaactagtggcttgcggacggattttgatctggacatcatcagcctgaaagaggatggcctggagaaggttggggtgtggagtcctgccgacgggctcaacatcactgaggttgccaaaggccgaggccctaatgtcaccgactctctgacaaacagatcactcattgtcaccacagtgctggaggagcccttcgtcatgtttcggaaatcagacaggacgctatacgggaatgaccggttcgagggctactgcatcgacctgctaaaggagctggcccacatccttggtttctcctatgagatccggctggtggaggacggcaagtacggggcacaggatgacaagggccagtggaacggcatggtcaaggagctcatcgaccacaaggcagatctggccgtggcccccctgaccatcacccatgttcgagagaaggccatcgacttctccaagcccttcatgacacttggtgtgagcatcctgtatcgaaagcccaatggcaccaaccccagcgtcttctccttcctcaatcccctgtccccagacatctggatgtatgttctcctcgcctacctgggggtcagctgtgtcctcttcgtcatcgccaggttcagcccttatgagtggtacgatgctcacccctgcaaccctggctccgaggtggtggaaaataacttcactctgcttaacagcttctggtttggaatgggatccctgatgcagcaagggtctgagctgatgcccaaagccctgtccacacgcatcattggtggcatctggtggttcttcacgctcatcatcatctcttcctacacggccaacctggctgcctttctgaccgtggagcgcatggaatcacccattgactctgctgatgacctggccaagcaaaccaaaatcgagtatggggctgtcaaggatggggccaccatgaccttcttcaagaaatccaagatctccaccttcgagaagatgtgggccttcatgagcagcaagccatcggcgctggtgaagaacaacgaggagggcatccagagggccctgacggccgactacgcgctgctcatggagtccaccaccatcgagtacgtcacgcagaggaactgcaacctcacccagatcgggggcctcattgactccaagggctacggcatcggcacgcccatgggctccccataccgggacaagatcaccatcgccatcctgcagcttcaggaggaggacaagctgcatatcatgaaggagaagtggtggcggggcagcgggtgtcctgaggaggaaaacaaagaggccagtgccctggggatccagaagatcgggggcatcttcattgtcctggccgccgggctggtcctctctgtgctggtggccgtgggcgagtttgtgtacaagctccgcaaaacagcagagagagagcaggtaagccttagagcttggagcctgcacaggatgggaaatggagattcgcgctgatttcactcctgtatgtgccaggcacacagtggtgtctcatctcagcctcacaacagctcaccctgcatccagtcggccagcaagccctgccactctacctctgtcctgacctggcacttttttccatcgccgttgccccaccccaggccaagccccatcacctcctgcctggattatgccgcagccttcaaactggccctccagcctccatgcttccccaacaccatccacaattcacacagcaactggtaccttgtttaaaacttaattcaaaccatatcattttcctgcataaaaccctccagggtaattgtt

SEQ ID NO: 8978 - DNA, 558 bp, Homo sapiens
  ENST00000462621
gcggccgcttcatgaacttcatcaaggaggctcaatgggaaggattaactggacgaattgttttcaacaaaactagtggcttgcggacggattttgatctggacatcatcagcctgaaagaggatggcctggagaaggttggggtgtggagtcctgccgacgggctcaacatcactgaggttgccaaaggccgaggccctaatgtcaccgactctctgacaaacagatcactcattgtcaccacagtgctgttcccaggcaaaagcctttcccacaagtcaccccagctgtggtgggtgctgtggccacacctcgagagcccagcaggtgctgggagcctgtacacatgccgcattctatagtggcccttccgagagccgtcagccactgccacaccccctgcctggaatcacaccccatcttctctctattccccaactgaatagcaccgccttctcctgacctgtttcaaaccaagaagcaactctgggggcctcccatgggctctctgcacctttgagctcatgcgggggcaggaggacagacccaggctgctga

SEQ ID NO: 8979 - DNA, 550 bp, Homo sapiens
  ENST00000479620
caacaaaactagtggcttgcggacggattttgatctggacatcatcagcctgaaagaggatggcctggagaaggttggggtgtggagtcctgccgacgggctcaacatcactgaggttgccaaaggccgaggccctaatgtcaccgactctctgacaaacagatcactcattgtcaccacagtgctggtaagagcctgcagcccctgcaggaaggactgtccgacctgggggtggggtggccgttcgggctggagagtcccctctatcccccccacccagaagatggaggctgcaggtaggtggagacttttagagtcagcaggaagttctcagagagcagctggagcgcagcagcgctgctcgctgccacgggcggaagccgctgcgtttttgtgtctcactcccactcactccccaagtccttgatgtctgagtaggaaccatgctggatggtggaattaagggggtttgacagcccattgcaacctgagtgaggattcgcctctcccaccccagttcccaggcaaaagcctttcccacaagtcaccc

SEQ ID NO: 8980 - DNA, 14450 bp, Homo sapiens
  ENST00000396573
atcatgggaccgggtgagcgctgagaatcgcggccgcagccatcagccctggagatgaccaggagcggccactgctgagaactatgtggagagaggctgcgagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgcatctgcactgtagtgcgattgacatgtgcaagagattaggaagtttggctcgtaacagtttcagctttcttgttatgccttccatcacagcccaggctcaccccaagaactccaggctcccctaaagaatagcaaatcagtgtgttcgtgatgactgtgctaccttcattatagttcatttccaagacacatctggagccaaaggcccgagggaccctcaggtggggagagctacaggaatctctttggatgttgatgtgtgtttctctcaccctcggcttcgatggtcttgttcagagctgcataaactaacacatttatgtctccgagatctaagtgtggatcttctgtctgtgacacagtggccattgtagtttatcccgaagacgcctatgtacgtaagtttgcatttcctcccttctggtgatgactcagggttgtatagtatctgttaccccttccctcccagagtaaccataactcgttccgtttccaaacagccatggtggtgtccaattagctgtgtatcgctcttcccagagttgttaatgtggtgacatgcaccaacagccgtatgtgtactgtgatctgtaagaagtacaatgccatctgtctgccgaaggctagcatggttttaggtttatcttccttcacatccagaaattctgttggacactcacttccaccccaaactcctcaaatcaaaagccttcaaaacacgaggcactcttggatctaccctgagtatcctccaaactgtggatacagtttagtgagacaagcaatttctcccttctgagttattctctctgttggtggcaaaccacttcatagcaccaacagagatgtaggaaaaattcctcaaagtatttgtcatttctgagtcgcctgcattatcccattcttattctcctcaaacctgtgcatatatgacatgaaatgatatccattttttttttaagttagagacagagaggggaatacttatgcatggggagcctgttagcacagtgcctgccacaaaaacaagtgcccccgacaagatagttgctatgttatgacactttctcagatcaggattttctagtttaaaaattaaatatcataaaaccagcaaataatattaactaaaccttttatatagttctactctgttaattagtgtatttcatgtacatgaatatttttgaagtatttgggataactagccatcagtgtttgcagaagacctcagtctgttttgggccattacggaaacactaagctaatgtagactcgcctggccatttcctggtttcctcctgcattctgctttacattcttgaagaaagggataaagtggcaggttgaaaaattatcccatttcttctcctcatggtgtgcgttctgttttgtaagtattattttcttgcatgtgggcaagtgtcagggatgattcccttaaagctcaaggatgcatggaatagctccatctttgggaaagtacacctgacctacagtgttcctataatgaaaagtggttgcaataaatttcagggtcaatcatagggagacagagggaggcagtgggtgagaggagcttcctttcatttttgaaaggcagaaggggctgactaggtgctggggatgcatgtgcttgaaaatgacattttatttcccggatgctgtacctctgctgccccaagacccagccatggagaagcctggatcgaagggcccagaatagtcaccccaacatctgatcctaaatctgaatctccatgactgtgtagccttttagccctttctaccttctgcccttccagtgcattccagaccttaatccaccccagcaaggatcgcctccatttcctcatgagtctgggatgttttgacatgaatgaattaaaaagtcttcccagaatacagaagagtgatttgtcgtcaagccaaagaggctttctgtcttcctctggtgtcctctaaacccagggggctgccaaatgccacagagacctccagggagagtgagagttatacttggactgacttcatcggtcagaaagccttcccctaacagcagcattatttctgctattaaccccatacatctctggataaagaaactgaaaacgtggcctttggaagaatcaacagtaatgttgtgaaaaaaatatatattcttttcactgaccgaagtgttttttcaaataaataatcagaaatgttatgctacacaaagtttatggtatcccttctctactaattcaatgactcttcaatgtgatgatcccaagcaaaaaaaaaaaaaaaaaaaaaaaatcaactactgatcagatggtcaatttctaaggaaaagatgtagagttattcaaaggtcatctaagtcagttcagtctttgcaaaaagaatatcaggaatgtaacgtccagtggtaaatggaacccacagtatgagaagtaacaagaattaaataggaagcctggaagcctgagactatagatctatcacagaagattcccgtaacatatcccagctctgagttcttagatttgttgatgtcaaggagcccaaatttctgaacacaaatgcctgagtttcagctggcttaagtcagagctggcatccataatgatattttgttaattctaattggttttccccacttgagaaggacccaactagtcctcagataggtacacttgaatgcaaacggttgggtctctgtccatgggtaatagcacgcacatgcaaccaatttaaaatactctgggtaagagagtcttctagagcataaactgtacttgagaaacctttgtgcttctggaaaatgggtttcatcatccttacatctgcaggttcttaggccacttatggtttcaatgctctgagctggcaagtccctataggtctatctttctgccagagagacttgcaggattataatctcacaatctcaccactcattactgttatgtcctctgcaaatctctctgcgttattttagccagcaccatgactgggcatccacggattactcttgattttctcttccctgattcacaggatgccagagagtctgagtatttagtttttctggtgaaagcattaaaattcacacattgcagcaaaatctgtcaaatcatttcacgcttattttctggggagaaaaatagaaaattacaccttgtttacaaatgaaatagtttcacttaaatgggactctagccaaggcagttaattagtcaaaagatccacagctgtcatatagtcacacattgtttattctatttgctatgtcgaccactgatgtgtatttaatattctgcatccttcacaggaaatgacaaatgccctgaattatttgcaaatagaattgctaatgaaaaagaaaaaaaatgttgatgttaattaaatggtgattaaaaatttatctcctttaaatctaaaaagtgcagctttaataatcagttgtcatataaataagtaccttgtactgaaatcccttgcggtttaagacctaaataaacactaatttgagaactctaaataccttacagaggagctggatatattcgttaacattatgcacattcctgtactgtttctttgtgcatagctgttgtgcatgaatccttgaaaaggggacatgcgttgtttctgaaatggagcctgtttgtattaaccatggctatagtagacatgattggactcaaagaaaaagaagtttgagtaggtggaagctaaatgtgttgcttgatatttaatgagtgaagggttctatgtaaaggcaattttccttccaaaagtactgtttattttcactggagacaaaattagacctttccagataccccatctctttttggtgaacagggttgaaagtgctgtggggtctatacttgaaaagttctcccaatatgcagttactgtttcccattcaatccctatacattgtactgtgttcatatctaattgtatcagatgaggtcagcttgccacttgatatagatcagagatgatcaaatgcacttatcctgtgaatacaactgcttgtgtacacatgtatataatatacatgcttgatttctacaattcacacgtaagtgtattatccaaataaaattgtacatattgtaaagtttatgttaaaaattaaatggtgatgatggtattaacacatggaaaacccattctggttatttttatgggaggatatttctgtagagagggcactatatttttttaatctcagttgtagggaggatgacagagcctaagtagaatatgggtgttggcgttcttggccccttctttaaaaaacaaaactctgggatgaggggtatagaatatattctgctcgcatttgcttctgaagacaatgccgatatggacttgtgtgtgatttccttaaacacatcaaagggcatagatttcctatttaaattccttatcctctttcctcacctgcactctttctgtgcccagcagtactttcagtatagtattagctagaagtgcctgcccagaagggtcttagaaaaatagagttcgtagaaccacaccaaaagttaggagaaggggaggagagatgagaaaaatgaagtttacaaatgggcagttgcctgtttaagatcatcaagttagagagtatcagagcgaggattagatccaagacatggttcaatttctggctcgattctctgaccgggctgacttatttctaggtttctttcaaggggaaactcctgagtagctctggaataagagccagagatccccataaggctgccctggtttttgttttgttttgttttttgtttttgccacttgccccagaaagacctacccatgcttctttgaatttggttttcctttaaactccctcacaatccctgtcttaaagttcctagaagagaaaacttttctcagagaccgtctccttaggaaaaatcaacagggatattgtttaaaacctcaaactgaagataaaaggctggcagtgaccattgaaataattgaggtctatgtatcatgcattgaggaagaaccaagcacattgaccagctaataggacttcactgaatgtccactttattttgaaagccagtttgggattgtgggggaggggatgcaaaataaatagaaaatatagtctcttcccataagtagcttatggtttagaagttcagttctctaatacaaaggataaccaaggacccatgcaatgcaaacagagactaaacagcaaaaattagaaatgacaactaaagttgtagccaggaaaaaaaaaataatctgattctatgagcataccttttttaaaaaaaaaaaaaaagtccttccctaaacctttaagtaactccggagaatagagttagtggtcccggaaatgcagttgatttattttaatcttcaaataatggacttaggagacccaggagctgctaaccaggtgaacacactcacactcctacatttttgcacaggaaggcttttgtctggttccaaccagttctccagtccttgccaaatcatgcctcctcccagccttgcattatgacatgtgcctcaagaaaaggttgaaaaaattccccaaaggattagaaaatagaccatgatgtaaaaagacgaagcatttccctaaagcttttttgtttggttttgtttttgacatttgaagaacccttctgatacaccagggtatgaatgtatcagggaagcatagagggaaaattctttatcaagttccaagtgcctactgctgtggctgacagaaagcatcaggttccctagagagaaaacggggcaaagagatggcaaaaggaatagaggtgtatttcaggaaggatggcgaggtggagagggagcttttgtcactctgtctatcccattctgtgcattcttggaatgttacattttctgcttatcgcaagtacttgccatggatctgcacctgaatttgaaaatatcaaaatatatctaaattgagtgtaggcgatattctaggcatatcctagaatgtgatcctcaaaacaaccttaagatataaatatgattgctcccattttacagataaggaaactgaggctcaggtttttctcaacctcgtcagcaactagaattagctagtaaatccctaacgttagacatattttcaaagtgcctggtctcctccagggaggtcagaatagaagtcagaaagagaggtgtgctcttttgaggttcctgggcatatacccttgagtatcagcctctgtgacagggaagtctgttagggtcttacccctcattgcctgatctgtgtgtatggagaacttctggggatctcacctctgttcatagttccttctgagacttgaacactgtttgtgtctccctttcatatgcttgcacttagcatttaaaaaaatttctggggagttattttctctacttagcatgtgcctaatcttaaatatctctttcctaatgtctcatctttttatcagtcaacatcagggctaattccattaaacatatatacatagtacatgctctcatgtgtgtgggtatgcacacacacacacacagccatgtgaccctccattaaagtcctcctaaatattgtgacccatgttcaaagaggtgatattatttgcaagttgactattcctcctatttcatgtctatgtttggttatctttgccaggcagatggaatgagtttcagaggtgggacagggaataggaaatagagtttctgcatgaatgatggagagctttggtagtcagaatgattgaggaccagctattaaaatgttgttgttgttttccttcttggtctgttcctttttttttttcttttccaaattgtcttagagataattcccggctcacttagcattaggataatgacggttattctgtcccactgaagagtgttgaactggaacgcttccaccgggctttataggtacccagaatggcctaatgtttaacatatcctgcaggcatgcccctgagcacacactgcctttcctgcattcccccctctccatggtctaagccacatttctttcctggcatttatatttactgagaggtgaggggtgcattaggcccatttgatggatgaggacactagcggggatttgaaggaatgtctttctgggagtctccatgaattctctggagagttagctaacttaatgcaagttaagtgctagtctatgagaaaaatttctcagctgttttcatctttcaagctggcagtaaaaagccttttaagacagaaagattattatttgttatttggagatcctgttgttgggtctacaagtgcgtgaccatgttctccttggaatgttgagctatgcagaaatggagcactccaaagaacgatttgaccaatagcatttcttctctgggggttgtatttcaaagcatgcaactctccagggaaccagaactaaattgcttaaaatgaagtcattcctcagattaacttcctcagataaagtgtcagcggtctgcagaaacgaagaagacaaaactgagattatcactcataattctcttacttactatgtcagtgaaacaatgagtttgcatttttgcaatcctagaacattcttcattagccctgggtcatgacctcttccagttaattctctttcacacctttaggaaagatttaagatgaaccttcaataggatattaacataactcatagccaataccacagctgcctttcaaattaatgaggttaattgttctccagcaaacatgagtttgtctttggcattttaaatgcttcccattgatctgacattttgctgtttcaagttttaaagggctcaaatcaaagactattgataactgagcaaagagcgaagatccagaaatacgaaaacattgtctttttttttccatgaaaaacaatcatagccttttgaattcaatcgaagtttctacattagccatctaagacttatttaattatttctgttctcagtcaagctaattcaagtgaatgaacagtattgacttttaaaatcttttttaaatttttttaaatctttagtttattaagtttgtagaaaagctctggggccatgaccacttacgtaaatgtttcagtttaaaaacaaaagattcaggcctctaatttgagccaaatccaggtgatcttgtttgaaatttttgatgaatttgaaaagatgaaagtggaacttttaacattcatgttccccaaatttttcactgggaagggatgctaattgcctacttaagatataagttcaagaataacattttcatagaaaattcagaaaactgcttgacacagcagtgacatagttagatgtggctcagatgccttccaaacctgagggtccccaaagatttctttaccagttgtttttaactatgaatcttaatcttgttcattcccctgccaaaacaaatttaaaagcataaacctgctgaattaattggcagaattcaccatagtttatatcaccccagaatgtttatgtgtatatgtttatgtatagtatatatatttcaagctgaatgttcagaaagaataaggtgagtttcttggtagcttgaataagaattagatcataaaaattataaataatggccttctcaaagaggataaatgattcatttttcactcacgtattaataatatgacttgttgcataatacacaagctggtcattgcctgcaagaaagttattgaattaagcagctatccaggtttatgtctgagtccatttttaacccaacaaggctaggattgaactccatatgcagagggtttctattcacagctacattcaaacagaatccaaaacccacatcagaactgacttgatgtcttgtatggtggagctgaaagcaagctgtctgctctaagcaatggtcttcatttgggaattaatgttcactgatcaactgcagcagtttatatctgtcatgttttaatccactgcatgaggaagtgctaataagtgtattaaatatttccaagcatagctacaaaattatatgtttgcttaacacctttctatgatagaggaagtatatactatggttgtcttcttgtagtatgtcttttaattttgttcaatgtgttatcaactgttttaaggaatggggattgaaattcgtgtgcaaactgatatgtatataactcctgaggcaacagaagtgcccggtcatatggtgtaaaaatgtaaatacaggaaaatttcatttttctaataaagataatttctgccaattgatatgaaaatgagaaa

SEQ ID NO: 8981 - DNA, 4165 bp, Homo sapiens
  ENST00000461292
atatatccaatatttctcctgttgagagtttaccagcctgtaattttcttaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgca

SEQ ID NO: 8982 - DNA, 4692 bp, Homo sapiens
  ENST00000636273
agatgatgagctcatgcctttgtgactttgtttcttgagacctgcctgatttccatggtcacaagaacacagagaaagatgtgtgggctcccggggctctgcctgacactgttgagagcgattccagaggagaaggtatctgtggggtaatcttcggatgttattctgaaaagccccaacgtcttcctcataacagcttctaagcttgaggaccaagagttatcctctaaaaaggtgtccccaaacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaaca

SEQ ID NO: 8983 - DNA, 4338 bp, Homo sapiens
  ENST00000562109
tcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagg

SEQ ID NO: 8984 - DNA, 5031 bp, Homo sapiens
  ENST00000330684
cgctcagcagctcccggtcgcacaactcccagcagccggcgctggggaggtggtagggggtgcgggtggaggtgcccagttagcttctcgtgggtggccaacctggggctcccattctcctgtgcaccctggagtggagctcccgctatcagccacaggggctgaggatccgcactgggggcgtcgtgggcatcgggcttcagcttcccccctcttgtctagcccccctgggcgcataggggggcttgtgagcactgcagactgcagccttcccctcaaccctccctcccctcgttggtgggctgaccctgcctctccttctctcctccgccccgttagagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccct

SEQ ID NO: 8985 - DNA, 488 bp, Homo sapiens
  ENST00000463531
tggaaacccagcaaactcagaaacttgtcttaaggttacatagctgtgagttgcacatcgtctgttccaaacccagaagcgtctgccccaaagtgcatgttctggtcctcactgcctgtgaatgttgtgatctgtccaggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaa

SEQ ID NO: 8986 - DNA, 430 bp, Homo sapiens
  ENST00000566683
gggctctctgctgggtgccaggaacgcagcactgaccacgacaaagcccctgccttagagagatgacgtttctgtataaggacagagacggcaaatggacaagcaagtgaatgaatgtggcaggaagcagtgtggctgggaagaaatacttaaaagcagggcgagagactagagcatattggctgccatttaggcaggaaaaacctcttgtgctgacatttgaagtgaagggacacccatatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgt

SEQ ID NO: 8987 - DNA, 1142 bp, Homo sapiens
  ENST00000568247
aggccagcccatgctgaaagctcaccaactccagcactcaccagcgaggactcctcatgtctcactgggttccccttccatcatcagaagccaaggatgtttccaaaatattccatcgatgtccagagcagcactggaagagcagtgagcatggggagagaagtgcttttgcttcagaaccaaagtgggtgtatgaaatctgttcctctcccccagctgcacattctaaggaagccgagtgccagaggtggtcagaggctgatatgtagaatccgaaaaatacaggctgagccatggcaggaggaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccgtaagaaagggcttgttgtctcccaaagtgggatcagagttttgctgttgtcattgtttgcttgcttacatactcattgttggaaatacgcactgaaaatgcagaatgttatgtgtttacttacgggacttttattttgctctcctctctctttctttcatctcctttgtaagaaaagtcacattagactttgtttcctgcaacttaacttttttttctactcaacaatatatcttggaaacc

SEQ ID NO: 8988 - DNA, 833 bp, Homo sapiens
  ENST00000637393
gacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccgtaagaaagggcttgttgtctcccaaagtgggatcagagttttgctgttgtcattgtttgcttgcttacatactcattgttggaaatacgcactgaaaatgcagaatgttatgtgtttacttacgggacttttattttgctctcctctctctttctttcatctcctttgtaagaaaagtcacattagactttgtttcctgcaacttaacttttttttctactcaacaatatatc

SEQ ID NO: 8989 - DNA, 655 bp, Homo sapiens
  ENST00000566670
gtgcaccactgtctacgggctctctgctgggtgccaggaacgcagcactgaccacgacaaagcccctgccttagagagatgacgtttctgtataaggacagagacggcaaatggacaagcaagtgaatgaatgtggcaggaagcagtgtggctgggaagaaatacttaaaagcagggcgagagactagagcatattggctgccatttaggcaggaaaaacctcttgtgctgacatttgaagtgaagggacacccatgatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagag

SEQ ID NO: 8990 - DNA, 166 bp, Homo sapiens
  ENST00000637334
gccgtagcccagatgctggattttatctcctcccacaccttcgtccccatcttgggcattcatgggggcgcatctatgatcatggctgacaaggacttgctgagagctttatcctggcaaacggaagctaaatgtggccagcatgaaagtgatcgcaggagaagac

SEQ ID NO: 8991 - DNA, 1322 bp, Homo sapiens
  ENST00000566665
atcagccacaggggctgaggatccgcactgggggcgtcgtgggcatcgggcttcagcttcccccctcttgtctagcccccctgggcgcataggggggcttgtgagcactgcagactgcagccttcccctcaaccctccctcccctcgttggtgggctgaccctgcctctccttctctcctccgccccgttagagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggtaaggccggaaactgatgccctgccaggacctgggaagccaccagctgcatggcagctgctgcaggtcttcggacgcccctagaatctgtcttgatgtgaagtgggggtgggggtgggagggtcgtggccactggccctggtgagaaccaggtcttgcctctccaacccagaaatgaatggaaatgccttttgccttgtttctgaaaatggtgtacacaggagcactttggtgtgtgtgtgccaggaagcgctcagaaaactgagaagtaggctgtggggtggtggtggtggcggtggtggcatgtttggagatttacgagtaccatggggcacagaggtgggcccaggagcactggagacatatgcttcctattttcacaatgccagttttacctgattgttttgtgggaaaatgtccattttttcctcttatggtaagtgactaaaactatttctaaaaattattaaatgtgggtaggttctggaagaaaatgcaaagttttta

SEQ ID NO: 8992 - DNA, 100 bp, Homo sapiens
  ENST00000636406
acagaacacgcgcggcgcttaggggaccgtcagtggcgactatgggcagagtgggctattggaccctgctggtgctgccggcccttctggtctggcgcgg

SEQ ID NO: 8993 - DNA, 100 bp, Homo sapiens
  ENST00000637188
ccgagaggcgcgcgtcagggcacgcgtgcacgaccgtgctggtatttgcagggaccgtcagtggcgactatgggcagagtgggctattggaccctgctgg

SEQ ID NO: 8994 - DNA, 4118 bp, Homo sapiens
  ENST00000535259
ctggcaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgc

SEQ ID NO: 8995 - DNA, 139 bp, Homo sapiens
  ENST00000637214
gccaacttagctgccttcatgatccaagaggaatatgtggaccaggtttctggcctgagcgacaaaaagatgagaacactgagacttagaagaagtatctttcccaaagtcacaaagttagtgacagagccgggattcg

SEQ ID NO: 8996 - DNA, 30355 bp, Homo sapiens
  ENST00000609686
cccttaggaaggggacgctttgggaatgaccatgctccaccgagggacggagccggcccccagcttctccacacagagcctcctccactaacgctccaaaaaccaaaaaccgtaattgccagaagaagcgttaaaaatctattccagccactaacctcacatgcacacggaataattactctggattctgcattgtgagctgctctccataccctgaattacctttgaattaaatctttttttttttgaatttgcatctcttcaagacacaagattaaaacaaaatttacgctaaattggattttaaattatcttccgttcatttatccttcgtctttcttatgtggatatgcaagcgagaagaagggactggacattcccaacatgctcactcccttaatctgtccgtctagaggtttggcttctacaaaccaagggagtcgacgagttgaagatgaagcccagagcggagtgctgttctcccaagttctggttggtgttggccgtcctggccgtgtcaggcagcagagctcgttctcagaagagcccccccagcattggcattgctgtcatcctcgtgggcacttccgacgaggtggccatcaaggatgcccacgagaaagatgatttccaccatctctccgtggtaccccgggtggaactggtagccatgaatgagaccgacccaaagagcatcatcacccgcatctgtgatctcatgtctgaccggaagatccagggggtggtgtttgctgatgacacagaccaggaagccatcgcccagatcctcgatttcatttcagcacagactctcacccccatcctgggcatccacgggggctcctctatgataatggcagataaggatgaatcctccatgttcttccagtttggcccatcaattgaacagcaagcttccgtaatgctcaacatcatggaagaatatgactggtacatcttttctatcgtcaccacctatttccctggctaccaggactttgtaaacaagatccgcagcaccattgagaatagctttgtgggctgggagctagaggaggtcctcctactggacatgtccctggacgatggagattctaagatccagaatcagctcaagaaacttcaaagccccatcattcttctttactgtaccaaggaagaagccacctacatctttgaagtggccaactcagtagggctgactggctatggctacacgtggatcgtgcccagtctggtggcaggggatacagacacagtgcctgcggagttccccactgggctcatctctgtatcatatgatgaatgggactatggcctccccgccagagtgagagatggaattgccataatcaccactgctgcttctgacatgctgtctgagcacagcttcatccctgagcccaaaagcagttgttacaacacccacgagaagagaatctaccagtccaatatgctaaataggtatctgatcaatgtcacttttgaggggaggaatttgtccttcagtgaagatggctaccagatgcacccgaaactggtgataattcttctgaacaaggagaggaagtgggaaagggtggggaagtggaaagacaagtccctgcagatgaagtactatgtgtggccccgaatgtgtccagagactgaagagcaggaggatgaccatctgagcattgtgaccctggaggaggcaccatttgtcattgtggaaagtgtggaccctctgagtggaacctgcatgaggaacacagtcccctgccaaaaacgcatagtcactgagaataaaacagacgaggagccgggttacatcaaaaaatgctgcaaggggttctgtattgacatccttaagaaaatttctaaatctgtgaagttcacctatgacctttacctggttaccaatggcaagcatgggaagaaaatcaatggaacctggaatggtatgattggagaggtggtcatgaagagggcctacatggcagtgggctcactcaccatcaatgaggaacgatcggaggtggtcgacttctctgtgcccttcatagagacaggcatcagtgtcatggtgtcacgcagcaatgggactgtctcaccttctgccttcttagagccattcagcgctgacgtatgggtgatgatgtttgtgatgctgctcatcgtctcagccgtggctgtctttgtctttgagtacttcagccctgtgggttataacaggtgcctcgctgatggcagagagcctggtggaccctctttcaccatcggcaaagctatttggttgctctggggtctggtgtttaacaactccgtacctgtgcagaacccaaaggggaccacctccaagatcatggtgtcagtgtgggccttctttgctgtcatcttcctggccagctacactgccaacttagctgccttcatgatccaagaggaatatgtggaccaggtttctggcctgagcgacaaaaagttccagagacctaatgacttctcaccccctttccgctttgggaccgtgcccaacggcagcacagagagaaatattcgcaataactatgcagaaatgcatgcctacatgggaaagttcaaccagaggggtgtagatgatgcattgctctccctgaaaacagggaaactggatgccttcatctatgatgcagcagtgctgaactatatggcaggcagagatgaaggctgcaagctggtgaccattggcagtgggaaggtctttgcttccactggctatggcattgccatccaaaaagattctgggtggaagcgccaggtggaccttgctatcctgcagctctttggagatggggagatggaagaactggaagctctctggctcactggcatttgtcacaatgagaagaatgaggtcatgagcagccagctggacattgacaacatggcaggggtcttctacatgttgggggcggccatggctctcagcctcatcaccttcatctgcgaacaccttttctattggcagttccgacattgctttatgggtgtctgttctggcaagcctggcatggtcttctccatcagcagaggtatctacagctgcatccatggggtggcgatcgaggagcgccagtctgtaatgaactcccccaccgcaaccatgaacaacacacactccaacatcctgcgcctgctgcgcacggccaagaacatggctaacctgtctggtgtgaatggctcaccgcagagcgccctggacttcatccgacgggagtcatccgtctatgacatctcagagcaccgccgcagcttcacgcattctgactgcaaatcctacaacaacccgccctgtgaggagaacctcttcagtgactacatcagtgaggtagagagaacgttcgggaacctgcagctgaaggacagcaacgtgtaccaagatcactaccaccatcaccaccggccccatagtattggcagtgccagctccatcgatgggctctacgactgtgacaacccacccttcaccacccagtccaggtccatcagcaagaagcccctggacatcggcctcccctcctccaagcacagccagctcagtgacctgtacggcaaattctccttcaagagcgaccgctacagtggccacgacgacttgatccgctccgatgtctctgacatctcaacccacaccgtcacctatgggaacatcgagggcaatgccgccaagaggcgtaagcagcaatataaggacagcctgaagaagcggcctgcctcggccaagtcccgcagggagtttgacgagatcgagctggcctaccgtcgccgaccgccccgctcccctgaccacaagcgctacttcagggacaaggaagggctacgggacttctacctggaccagttccgaacaaaggagaactcaccccactgggagcacgtagacctgaccgacatctacaaggagcggagtgatgactttaagcgcgactccgtcagcggaggagggccctgtaccaacaggtctcacatcaagcacgggacgggcgacaaacacggcgtggtcagcggggtacctgcaccttgggagaagaacctgaccaacgtggagtgggaggaccggtccgggggcaacttctgccgcagctgtccctccaagctgcacaactactccacgacggtgacgggtcagaactcgggcaggcaggcgtgcatccggtgtgaggcttgcaagaaagcaggcaacctgtatgacatcagtgaggacaactccctgcaggaactggaccagccggctgccccagtggcggtgacgtcaaacgcctccaccactaagtaccctcagagcccgactaattccaaggcccagaagaagaaccggaacaaactgcgccggcagcactcctacgacaccttcgtggacctgcagaaggaagaagccgccctggccccgcgcagcgtaagcctgaaagacaagggccgattcatggatgggagcccctacgcccacatgtttgagatgtcagctggcgagagcacctttgccaacaacaagtcctcagtgcccactgccggacatcaccaccacaacaaccccggcggcgggtacatgctcagcaagtcgctctaccctgaccgggtcacgcaaaaccctttcatccccacttttggggacgaccagtgcttgctccatggcagcaaatcctacttcttcaggcagcccacggtggcgggggcgtcgaaagccaggccggacttccgggcccttgtcaccaacaagccggtggtctcggcccttcatggggccgtgccagcccgtttccagaaggacatctgtatagggaaccagtccaacccctgtgtgcctaacaacaaaaaccccagggctttcaatggctccagcaatgggcatgtttatgagaaactttctagtattgagtctgatgtctgagtgagggaacagagaggttaaggtgggtacgggagggtaaggctgtgggtcgcgtgatgcgcatgtcacggagggtgacgggggtgaacttggttcccatttgctcctttcttgttttaatttatttatgggatcctggagttctggttcctactgggggcaaccctggtgaccagcaccatctctcctccttttcacagttctctccttcttccccccgctgtcagccattcctgttcccatgagatgatgccatgggccctctcagcaggggagggtagagcggagaaaggaagggctgcatgcgggcttcctcctggtgtggaagagctccttgatatcctctttgagtgaagctgggagaaccaaaaagaggctatgtgagcacaaaggtagcttttcccaaactgatcttttcatttaggtgaggaagcaaaagcatctatgtgagaccatttagcacactgcttgtgaaaggaaagaggctctggctaaattcatgctgcttagatgacatctgtctaggaatcatgtgccaagcagaggttgggaggccatttgtgtttatatataagccaaaaaatgcttgcttcaaccccatgagactcgatagtggtggtgaacagaacaaaaggtcattggtggcagagtggattcttgaacaaactggaaagtacgttatgatagtgtcccacggtgccttggggacaagagcaggtggattgtgcgtgcatgtgtgttcatgcacacttgcacccatgtgtagtcaggtgcctcaagagaaggcaaccttgactctttctattgtttctttcaatatccccaagcagtgtgattgtttggcttatatacagacagagatggccatgtattacctgaattttggctgtgtctcccttcatccttctggaataaggagaatgaaaattcttgataaagaagattctgtggtctaaacaaaaaaaggcggtgagcaatcctgcaagaacaaggtacataaacaagtcctcagtggttggcaattgtttcaaccagtttgaaccaagaactttccaggaaggctaaagggaaaccgaattttcacagccatgattcttttgcccacacttgggagcaaaagattctacaaagctcttttgagcatttagactctcgactggccaaggtttggggaagaacgaagccacctttgaagaagtaaggagtcgtgtatggtagggtaagtgagagagggggatgtttccaatgctttgatcccttcttacttaacctgaagctagacgagcaggcttcttccccccaaaactgattacaactgctacagagcagacagttaagagaaatgagcttgacctttaagagaaatgagctgcactccatgagtgcagctctggaggtacgaaaagaggggaagagacttggaaatgggagacgggggcagagagggaccctccaccacctctttgggcctggctccctgggaatgtgacttgagcccagagtgaacactcttggtagaagcccttctaccttcctgcaacaccttgtttccctctcagattgtaccattgaggaataaaaaaagatatacatgtataaaactccagggatgagggtaccagcagaactgatgctcccttcacttaacattggaaaattgagaagggaaatgaatatgtatcactgccggtcctgaaacttgcggtagggctatttattctatgggtcagttccactgtcctgccatcctcccctacacagggtggcatccagagagccccaggtctgtgtggaagcttgactgcaggatcgccatgttgcacacaggacacataaaccagaaaggtgctcatcctcctctggaaggaagctgccatgtctcttcaagtcactccctccagggctgctcttcgcccctgtttgccctcactcgtgacccttcctcatcccgcccttgactgctgtccccaaccctcctccttgatttttacctcagtatctttcattttaaagccaactgaaggccttgtaaagctttgttttctttctaaaatgaacatgggggcaaggggctgaacctctcacagatttggtgagaggagcacggagtgctttaccttagataacagaaaagactgagagaggacagagggcatgaggcacctccaggaggaagaaggcgaagggccacgtaaacactgcttcgccctgactctgtccaggggtcagggactcatcccctcatcttcctcttacctcacccctttcaaacaaaaaaaccaaaccaactaacctagcgaacagcaatctagaaccaagggagctctttcagtctccgctggcaacagaaatcaagatggtgtttatttcatatgtaaatattttgttttctaattttgtatagataaagtgttctcttgtgagtattcagggtgttgggctggagggagtggggtggtgatgggaatgagagggaaaaagtgttttgttatgggttttcatttcccattgggggaattgttttgtatggcttttttgcttcagggtgtctggaaaaagcgaatgctcatggaggccactatggtgaaaaagccaggggaaagtaattgtgtccatcccccccagaaaaccagtcttcttactggtttgtgagaaatgttcatgcactttggccagggttttacatagggttcaatttggctctaagcaaaccccaggtctgactcctatcttctaggtagaccctaggttaccacattccacacaaagacaggctggtggcaccatatttcctctgtcagtacctagggtaggaaagattcccaaaagggcttaaacagaattaaggtcaaattaacttcccattcttggcgtgactgaaaggtttcaggaagctcaatcctgagaaatctcccagcggcctcctctgatgctgaaacaatcgtctcagtcatctgagtcttttcttctttaggacctgggcgctgactcactccctgccccatctccaccctcagaagtcagcctggcaaacacacgtggaaaaatctccactaactctactttttgaagcatgtgatatctggtcacagagaggtagtgctggatatgtgtcttacaaatttgcatgcttttctagaaaagatgatgggatccactagaaactcagtggtgagatgattcccttagcaagattgctgaagttaggtttagacgtgggagggtgggtatgtgagcaatggtgccaatagcggctctttatttgccttgtcctcattactgccatcaggaaggtgctactggcctcgagccaggtgttcataatctggccttgggttaaccagacaaatagaacttcttttcctagactgttggctttgtggaggttggcagcctctatcacaggataaaatttccaaatccatttacccagtatattcactacattttttcctatcctcccatcataaaagctgttagctggacaattttatttttctaaacttatttggccccagttggttgcttttcttcaactggatatttgcactgggactaagttactcatggtctgcttaagaaaacttaaagaaaggaaggctgggcattgttaaaatctagatgttacttaattccagaataacaagcaagtaaaatgcatgaggaagaattcagctataagcccaatctatatcacagatgggtatgaaacaacacccaatccatccaaaactgtgagattccgcagataccctcaggagcacctaatattcccatgttcttcagaatccatgctttctcgctttgtaccctctatcattcccttccattgcagaagtggttggtgagtgtggtcctgtatgaactcctttcagtggcaatgcttaaatctcagcatttccactgacaataatctgacccttgaatttgcctgagtcgagactttgcacacccttcaaagtgatgcatgtacagtggactttgttatttcaaaatctgtcactgtgtatcctcagccagaacttgggaaacatccttcatatgtatttccctgcactggccacagccatgttgtgattgaggggaaaatcccaaatgattccattaaatgttgctggtgtcagtagtgccaaaaacgcatgtatgacatgatacagtaggagttgtctatacagttaagtgactatcactcacccggtcttccgtggccatcaggagttgcccaagggagaattctctgcagagtgctggtcacctgcacatgtcactaagaactaggtttctttggttcattttttttttttttttggtcggtttttagttagttagttcaagatttacagatagaataaccagattgtttgggcaataagcttttggaaaaactattccagaactcactttattctttcaatcatcatctctctaaaaaggccctgtcattgcttgacaccctgtgaatgtctgtttttgtatgttaggaatgattcagatgtgtgcataaatgatgtcactgcagtgatattgatgaatgcattcagcatttccagggactgtggccataccttatgtgctctctgagcccaaagccatataggaaatacatgctcagtaggctgctacacactacagcagagcttttgctttcttcacttgggtgtcagagacttttcctcctgtttaaggagctcttcatggaggagaagcagctgaaagtgaatagtcacactgggatgggtctggccttatgtatgctatgtggtccatggtgtgttgaaggtcctgaaaaggtctttttcatttcccaccccactgcaactaccaccttcccacacagatttgttgctttagcactgagctgagctgtctgtcattcgaatgaaagtaatcccaggaaaggtgacatattaagccatattagggatgtatacatttaatcacctaatttacattaggaatctcactccttttcctgggaataagttatgatacaagagaagaggaagggagcagagagcactgagagcaatagagtagggaacaaggatacaggttctagatggcaaagacatttaaaccatattttggcctccgcctgcttttatttaagcctcatttgacacctaaataggactcctggttaggaattattttcaatacacaatcatatgagtgtataatttatgaatttctaaattcagtatcttgtagggcaggttgagaactatgattctttccatagaaaatagaagagtgatgcttctcctccattacatgttactgagtaggcagctagaaaaatcaaattgaattagtgatacaataaaatttactgtcattgtctggtttctgtcccagtttaattaatcttccaattagctgagttggtctatatcctatactttccacctccatagggggtgccctgttatctggtaaaagagccacttatgacctcaggtgctacttaacctggggggcaattgtttcttaggcctagcagatgtttgggatgacactaaaatggcagattagtcagtctgagaatgtctaatattgatctgaatctaggattctattctagtttggggggtggggttgcagtattgtataaaatcataggatatctgagaacatcccaccctcaactcattccaaccacattgattcagtcacacagtggccctgtgagctctatgacttagaagagatagcctatctattcctatgacaaaggccctcacccaaaaccttaaattgaaagccagtgctgctactttcatgccttggagagaactgtgacgtttagggcttctcatttacaatattgaagcaagaaaaaagaattttgttcagagtaatgggttagaatagcagtactgggaataagtagggaaagttagaaatcttccacatttctctctacatctctcaagagctctgtacagtgagtttctggagctgcttcatgctttgaatataattgctggggtgattatgtggttaagggctcctgaaagaactgaaggtgaaaagcagagtagatgagtagaattcctcagagccttggcactctggtgtgtagaatctgtgttttggagaaggtgaaagaactcagtgcaagaattaaggtacaattaaaaagcacaacactaagcccaatttaaactgttattttaaagattaggtttccacactttaaacctgaactcttttatcggtaattattttaatgttgtgatttaggaggtggagcagattctagtactatgcaggagaaaaaaataaaagctctctggttaaatatgtgagtttaattaaaccaacgtctattgtgcacgtactatgtccctaggctagttctgtgaatgatataaaaggtttcaaaatggagtatattgtactcacgtagaatatatgaaagcataagtataaaatatgtaaatgtatgtataaataggtatgcatacatttgtatgattatacatgcaagtttaatattttctggtttcagggtaggagtcaaagatatccattatgctatttgaaaaaacattgcagagattcagcttcccatgtcatggccaggcctggacttattcttttgaaattattacacctcccagagctaaaactctgggatttcctctctaaccacaaccttgccttttctatatcttccttccttcaagacccctctgttgttctggtccataaatccatcaggcctcattgaattccctctttggtctaaccctgtatttacccacattagcaatattctcaccggcaattcctttttcctcttgccatctcactacaccaaccatgcttagctaactgcatcccatccccttgtcattcattgcatccccaagaagagcaagtcttaaacctacgtgaagagcacaaattcaatcaatttaacctcacctgaagcctactcacttggactttttaatttctccaatgttgactcagtgtcacattctgtgcttgataaatttgttttattttcctttcatgttcatgtcctgtctttcaacaggcaatctttcctactgtgtttgcaagaaaatctgattattgaatcctcacatatgctgtcctctctgcctttagatttctcttgtctttcacacatcttttccatcctttctcccaaccaagtgctcctcttccctatgctctgacctcttctgaggtgctctccagccaattgtatttctctcttttgcatctttaattccttccacacatctacctgcaactatctcaaaaacacccgtcctacaactatctctaaagacaaatctctcaatccaatttgactcttgaatttctgtcctatcgctatcttttcacttcccaacttctcaaaagggtagtctttctttctccacttcctcaccttatgctcatggcttcatcaatgggctacaccctaccactcttctgaaactactctcaggcaacgttccaatgaagttcttgttacaaaagtcaatagccttttttctttacttaccctgctcttcaacctcattgacaattaccattgggaggcaatacattctggttttaatcttagttctctggtcctctaacctcattggttcctgctcttcctcttatctccttagcattgacttgccatggtatatctgagcttgaccctcttctccttatcttaatgcttctgtagcaatctttctgtcttctatgatttcaataactctttgaatgaagatgaatcccaaatcttcacttttagcccctaccttttgcttttccttcatacacatacttccagtcaccttctgaacactcaacttcatcttgactcaaatatccaaaaccattgctgcaaaccaacataatcaccaacttcctccttttgcttaatggtatcaccatgtcttccgtcaccgaactcaagcttttcaggcacttttgcctcctccattttcttcatcctgcatatctaaaaatttgaaaagcctactaattcttccccctaaggtttccagtctttccttttcattcagacccttccttctagtctggattatttcagcgtcttttagcattgttccaatattttatatttgaatctactcttgtcagtactcacttcctacatataaatcagatgtcattcttcagatcaagaaacaaccttcagtgggcttcacttgccgtagtctgccagcaataatttcttgttacttgactatgtgtgtgtcccataatccagacaagctgaataacatttgtttcacctttccctaccagcttgttttcccacttgcgtcttcccttaaactgttccctttgtccaaaatactctccttcctatctcccatctcactcccttcttgaataatatccattccctctatataagtcttcaaagaccagaacaacttctttatcttccattcagaaaataattttaggcattttatgaatgcccataacactttcgttgtttctccctagtggcagctatcatgggccatcttatttcataggtatttggttatacatctcatctctcctgctacagcataagctccctgtgttcagggccatgtatttttaaatctttttatctcctgtagcactaaacagagtgccttgtatatgaaaggcattagtaaatatttgatattattataaattataattgagaaggagtcactttattttgcccatttgtatctgcagtagcacctaaggatgaatccccccagtttctctatatatatctgcacacacaatcacatgtatatactacatgtatacagttcattatttcaaatggaatctggatttttctaagtgctttgtcctttttctaagtgctttgtcctttgaagttgttttggactgttttatggttaggaaagtgtacttggaacactacatgtgttcaagtaagtgacagagggagaaactatgaaggatattgatcaaattttaggtatcagcttttcagatgctttgggtagagcttgtatccagacactttactaccaagattgagtctctaataacctgatccatgctgggactgatctgtgatccaatatttagcttcttttttaacactttcagcaccaaaagaaccttgtcacagttctggctcactaatcacacagccttgtagaccccaggtggtggtccaacaggaccactgtatttcaccacacgctacttccacatttgtggccttgggggaactgtctgtgctggtcaccaccttgtctttatatttctttcctgagttctttggcttctcaccctttctgaggctttgtctacaggatcacttctcccaaagggaggataagagttgaggtaattgagcactttacctcttatctgtatatttacaatgaaagtaagttaggatttgaatgagctggctcagagagaatgctagtctctaaactactcctttctctgtaaatataaagggattcattacctcagggggagacaacatcacttctgaccttatggccctcccttatcctctggtccctgtattcttgaagccctgttaacccttcctcctcctctcttggctctacttagcaatctatcaatcattctttctagccagtgtcagtctctgtccctctgaagaaactcttggagctcgtactgtcctttcacttcagctgctctggtaaccgataatgttttcgttccttctcccggccagccttctctgtaaatctcattatgccattggctatgaattattcccctttgggaggcatcttctgccactgtgtgctaatttaaagcatactatagagaactgaactcaaataagttacaggcagtgacaagtctctttttttaaaaaaaaagtgaagaaagtccactcttcattgagacaggagtgggtaggacaattattattggcaaggtagggcaaaacttgtgacaacttgggagatacctagtgaaaattaaaatataagtctagagagataattttgcttttcaaaagtcctatggggtctagatagccttgctcctgaaaatgagaatagttaatattttagagcaaaacccatttcattatactatgagacttttttttttagctgatgaaacaaattatctggtaaacagctggtgggagggtaggaagacagccatcctcatgaaggacgttcatgaatctcatttgggccaataaatggaccaaaattctaggcattttagccatgaactgttcatgtcaattattttgcctacaaatacccataaaaggaaagggaggatatgaggaaggaaaagaacaggaagtctacactggagcttccttttgtgtcaccaataaagccagaagctgacatgtgaggcacatggttcccccttggttactggcttcaatgatagcttcggaaagtagggaaacttgaaagagcaaggaccaaagcggagatgagtgaggaacctgaatgcaaccttatgtgtgaggtcctgatatccacaaggaacctggccccatgtcattcctgcccaggtccttcagattacagcacccaaggagcccttgatcatcaccctgggcagagggagtgacttatcacaccacccttacccacagaatttaggccaccaggctgtgactccatctgtcccccttgcagtaagagattcatagtctctgaaatctgacaggagaacagcatcaggggaaggggccacaggaatgcgaatttgttgagctgcctgctcctctaggataagtatattacctgtttccagaggggattgtttttttttcgaaatgaaacaaaacatgcctgcctaaaacttcagccctattcagaacagtcttgcagttaactgtcattgtcacattttaattgtaattgattttcttttgaaatccatggctattttaatgctccctttgaccatgacataagaaccctctgcaaaccagagacctggccattaggttgcctctggctgagttatactctcagtagtttatactttgctctcagatattcacctgaacagcacaactacacagaatttgatctctttgccatgagcattctgatgcctatgtacctccctaatgcacacacacaatcttaacaaatagatccaaatttcctatgtcaatcatgttatggtagatgaaagtgttcatttagaatgggataaagagacatatcataatttatgcagccagtgttttctctttgctctacctggcttgtggatcattgatccctcaaggtttgacagaaatattcaggcttcatgtgaaggcagcatgttctttgtgatgaaacaacctagttatcgtctccattttcccattttaccctatggaatccatgtggccttctaaggtcctgttgatggactggtactaagaggatggagaagcagaagccagtccccctgagaacagacagtcctgttgcttagatacatacatattcgcacatgtgcccacatctcttcttggaaacatcatgagcagaggtggagaggtctgttctcaatgggaggaataagggtaggagaattccttgagaatccctattctcaaggaatagggataaatgccttcacggattcaataatttatctgttctctctctcccagggtcaggagcaagaaaaatatcaaggtttcacataggcaggaagcaaggaggatagtgaagcatctaggtggaggtggaactcttactgagaaaaacatgaagtagtaaaatcaccctttctttgatataaatgcatttagaagtcaatgagggcacttacagctgtgtttcccttcactaacttttcatctcttgcattctttacttctctttctcaatttattcatcttgaggtatacttatcctgagttgactctgagcagcccatcctcaaaacacaaacaatgttaggatgagaagttgagtgagcacagagctcgaacacgtgcatggtacttaatgtttccaaactcgagcccaatcagtctagcacagtcaatcccactgcattttaatgactaggatggggcctgctgtacatagctggacatcttggattacagaaaagaggctttatgtgaaggcagcattttctttgtggtagagcaacatagttatcctgctaactgtcctatttgacctgatggaatccataaggtcctgttgatgggttggttctaagaggatggagaagcagaagtcattctactgagaacagacagtcctgttgcttagatacatacatattctttatgacagaattcctcctgagactcttgcacaccttcagtgatcagcgcattcactttggttatttcttggtaacaggcacgagaaatgggtcacatagaaatctgaagagtcatttctcgagcatttttagcttattcccatgtaaagaggcactgagctcctgcagttctagcctgcctctgctcccctccttggggaatggtggagtttctaggataaccagcaacccattaggctccaccacacttagcctatggtacattctgagtaaatcacagtagttggtatgtgaatacagaagaatttaccataaccacttctccaaataacctcctttgacttggaaataagatcatctttcagttttacagatgagaagtcaaagcacaaaattggataattagccaaaagtaagattatacagaaaattcttgacagaaccaaaacttggctgaaccaaaacttgtccaaatttctaactctcagtctagctcagcgagtaatgctgcctgaattgtctgcccccactgtaggttttcagcatctagcagtggagaaaagtcacgaaatctaggcagctgatttagccagatcttatctatgaaatttccctttgtagacacacacacactccacatacatctacagagacaagtcaaaaagagcaagaagaaagcaaaaatttgaaaatcagaaaggttagagaggtttccacggtgaagaaaacttggtcaaataaaaatgtttttgaattctatagggtaagatattgtgaataattttttattattaaaaattttttttaggtagcatgtaatccacataaataaaaaactcaagaataaactgggacagaggatttcttccagagtgctacatggcaaaagagccttcaggaacgtgtgcaggggtgtcatgatactccgaaggtgtcagtagttttggtcagcccacagtgagcagggcagcctcaagggagagccccttacatccttttctgggcacctctgtctaattaagttcaaacatacaagcctgattctaggattaaggcataagttagttctgaacagaaaaatataaggcagttcacatacacaatgaattcttgaagaaagaacctatagcccccagaccgataataaataattactgcctgccaaaatcctgaagaaagggaagcatgggggctccaaaattaatagtctcctgagaatacttatgagaccttgattttgtcacaaggttgcaatggtgaattatttattaagcacccgcagatcagagaatcttgcaacaaccttctcttacaacccacctgttcacttatgaatgatatcaagctcaggatataatccatctttccaaagattttagtatctttagtttgggctgcagaagaaattttggctcacagcattatgcttaaaccaaaaacagtgaaagagctctagtgtcctgcttaatgtagagtaactttttttttttatcagtccttcctagccctagagggaagataggagaggaggtaggaagatggaaaagtccttagatgaatgagtgaggagacttctataccatcaacttcagagtgtactgatccccggagcctggttcaggaggctagtttcagatgatcggaggaaatggaggaggtagcttttattcccatgcatgaagatggggggaggaggtgggcactagactaattttttaatctaaaaaaaatcaagcctattacaaatctcatttttcccttgtccttttgcctcccaataattcacataaaatcgtgttatcatagtaagctaagagagaggggcagtagctatttctaccttgactccgtggtgacttcatctttttcatgagtgtcattacagatacctggatcatgatgatcctgaaaaacaggtcacagggccaacagctgatgagtatttggagcatcttattcccccaagatgaccactccctgtcttctgctacacctatattcatcgggggggggaggtgggaaaatagcaggattcttggggactctgagggcatgaatggagaattatttgattgaaaccacagagctcttgtacttagtattaaatattaaaatagaaatgaaaagttcagcttttctgagctgtaccatagcggccaatggaggaagtcttacaaagaaaatctatatctgcacaagactgaagccactaaaccgagtatacacaacataaagatatcttcctatttcaagtatcccttagggggcatgggtgcttagctatcctatgaaagacagagaagataagctcaattttagagcccagagcttgctccggaacagcaagatccacatgaacttaaactctttcccactgagcctaggggtggaatgtaattcctctgatggttttgatttatttccaagctagacttctctatttgatcattggcaccttggcagctcacacatctccgtggtctcttctgtagctttcagaaaaaaaaaaaaaatatatatatatatatatatatacacacacatacatacatacatacatatacataaccctgtttgggtaaggcctattgacagaagccagatatctgggtggaagttagaagatgggcaaggaattcttatctcagagtttcaacactgcgacaatgtggagagaagtctcctgggaaaatgcagatgcccaataacttccaaaagaatcagggaagttggagtatttttgagatttacagtgtctttacttcagtaaaacaagccatagcaacattatgctctgcagagtcttctgttcacctttggatggaaaagagctgcttctcctagggagacaactaagaccaagaacaaaactcccatctcctaggccaattattgttttctcctttcctttcttttttattctctttgttacataatggtgaaatctacctggccattgccagtcaaacattctaattgctaaatatcatacagaaattcatgaaaaaagagtagaatcagcagatttcatttaatcccaagggtctttgcagttttcatcctctccctcaaagttatctcttctttgagacacatgatcacccctttcctcttctgggtggccatgattccaaaatgaacttcagtggttggtgcttcacaaaaggaaagacagctataatataaaatagaccaaaatacttatatttttagccactgcaaagtgggttttatcgttgagaacaaccttccaagctccttacttggaaacccttcctcacctcccagcctcctggcagctctcctggttccccttcatgtttttggctcccctccccgactttcctttcctatgaaaatgggatatatcccttaaactgtattcttatctaaactatcagactgttaaaagaaacccttgacagtaatttttcatggttttctcatcattttttaacttaggaagttggagaaagaatgacaagcaggcaaatgaggtcttgttcctgagtgcttcaactcaagatcaagtgctgggatagtgagtggctcttagtggagagggatgtgctctggaatattaagccacctctgagcatgtgtcctggtgctctggtcaagatgcctgttgtgtatgtggaggtattttgtggcttttcttgttctctctttttaaatttatttcaaggcacaagccctttgtgatggaggatgtctagcttgaacatgctggtaatgtgacactatcctcagctccccttggccctgggttcataggaggcaagtgtttctaaatttctcgcccagtgagttgttgcatgttatttttaaccattaatattgtgtgtctattggaatgagaaacagaaggttgaatgggaaatagattcagtgacaagcagacaaaaagcttggttctgagaaatgttcttcactgagttgaaaaaaaaataatctagaaacaaagaagagggaaattggggtagaatggtttggtggtgaagagacgatgacacccacatccagatgctctggtgtattccctcagagatttgtcattccctgtgagctctggcagaaggagaggctgtgctgccattgatggctcagaaatggtgacaggctggctttagaaagagacgtaggctttcttccagacagacattgataagcattgtagctcgattcttcaaaaccttgtctacaaacctttagggcagcccctctccaatgatttccattctccagtcaagaagattctgagtggaagagccttgtgtgcattgtgattacattgacttaaattgggaagccaaggggcactgagaactgaatatatcaggggaatggagttagctgaacctttttttttcaatattggaatgattttggatcacaaagttaggtcacctctgagagagaaaatctgttaaataaaattatatcttcccatctccagtgaaatcactaggttgttaatgtgattactgtttacttcagaaagaaaattgctagattcgattacaaataggcattttacagattgatttaatcctgagtcttacacatattaacatggaatttactgactcagacatgatcttctaagctataaaatattactggcgggtagtagatcatatgttctaagcaaaccaggaaagctaaaacgttaagtaatcctcccaaatattcagcgtctgtgtatttcactatagctgaaggggatttgggagttaggccgcaggggagaggagggacaaagtgccatagattaatgaaactcggagtaacttttttcttacctattaaaaataataattaacccaaggacaattctcaaaccagaaaaatcatgaaaagtgagctctgcacttgccattggttaaaatttagaaacacttagaataaatatccaggttttgggggaggagttgtttccttgcttgcattgttttgtttactggagctcttattttggggatatttggtctgtggcttcagagcatgttttggataaatgacttatccatgttgatatttattgagtggaaacccatgccaggctgttctaggtgctggaatataagaacgaaccacacaaagtccataccctcttgaagtttgtatgttgatgagaggaaatggacaaaaaagcaaatcaatagatctcatgtcagatagtgcaaagtgtcatgcagaaaaatgaggcagattaagggggatagatgataggatgggtgtggggttgctatttttgagtaagcaaagatgacatttaagtaaaggtttggaggaaatgagggagtgagacttggggctttctatgcaaaggcaaagagaaagcaattgcaaaggccctgctgtcaaaccaaatgcttggcaaacttgaggaagagccgggaggccaatgagggaggaggagagtatgagaggtgaggtcagagagggggcaataacgcaagtcaggtagggccttgtaggacactgtcaggatttggcttttaccaagagcaagatgagaagttgctagaaggttcggagcatagagtgatatgatctgacttcagttgaagaggaagctttgggactgctgtgttgagagtataccctgagagggcagacaatggaagcggctgaaagaccggttaggaagctcttgcaataatcctggtaagagatcatagttgcttgggccatgatgttagcaggggaggtgataagaagcagttggattccagaaatgttttaaagaatcgatatcacacagtttgctgatgaattagacattgaataagagaaagaaaaatcttaagaataaccttagaatgtttggcctgagctattgaaagtttggagttgccatcagtgtaagacaggaatcctgcaggtgaggctgactgggaaggaaagccttatagtttaaggtgtctacagatgttgcaagtagaaatgatgattaggcaattagatatatggacctggagttcagggaaaatgtatagcctgaagatacatatttaaaatttgtatgcgtttggttggtatttgaagccatgatactggaactagagaatgagtagcgacagaagaggattctctagactgaggcccagggtggaggattgttcaaagctccaggagatgagaagggaccagcaatgggaggagtggttaatgggtaaagcaagtactattattgagtaggataagactatctggaaacatggaggtcatcccattgatgacctggaagagagctgtttcagtggactggtgggggcaaaagcatgatggggtggattcaagaaagaggggaaggagaggaggtagagacaacaggaataggcaacgctttaggagtttggctgtaaagaggacatggaaatagcagatcatagagaatgtgacgcccagggagggacttctttttttaagatgggaaaaataacagcccattttatgttgacaagactaatccaggagaaaggaaaaattgatgatgcctagggagagaggacaattgctggagtaatgtctttgatgaagtgagagggcatgggattcaatacaaacatagagggactggcttcaggggactaaccaggtttgtttgtattaatagcagggagatagtgcatttgggcacagatgcaagtgggctggtaaatgggataatgggagtatgctttttctgattgatttttagtaaactatgaaaggagttcatcagttaagagtgagtataggggaagagtattggaggttttggaaggaagaaagcatgaatgagtcatatagccatccggcaggaagagtgagaacaaaaatgtcggagacaccaaaaatataggagacatgctagggggcataaaggaattatttgagtttttatgattatgagtttaaagaaatttgttttcttcagtcaccttcagctgcttaaacagggtggcaagttagattggaacagggttggggtataaccaggtgaatataatgaaagcaagagatgtggagtcaagggcaactgcagtgtgttaactataatgtttggtcatggaatctaagctgggtgtagaggaaagtgaggatttttagggaaggaggaacaatgaagcatattagaggcagaggattgagattcaagctgggatcactcagttagtgagtcagaagcaataacgtagaaattaggaggtgggttggagaggtggatgcttgaggttatggagggcttgcagttattggtggtttggggtctgttgttggggtggtgggctgagataagatagaggaaaaggttatagaaggagcaggggtcaaggaactgagaggccaggatatgggaattatatagatattgaagtcaacaaaatgttgacttccatatgataggaatgtaaattatgacaggaatgagggagagtgattcgagaacatttcaatcattgcatcaagtaaggggtgcagctagcctagtctgatgtgcatcaaagctggattttatggttgttgcatgttatttttttttaaaaaggagggaggatggtctggaatggcaatgaggggcaagaagggcatctccacctccaggccccagggcatgaggaaggtgcaagtggaaatgctcaccacctgggagtgattcagggtcctcaaagaggagccaggtttctgtaagagcaagaggaaaggaattgccagggttgtggctggtgatgaaccactgattcttaggcaggatttgggagttggtaaaggaagggaaatgagctgagatgggagatgtgcatgggtatctggggatgaaagtccaagtgataagagggactgggggtcttgggcttctcgtggtgattgccctaagcgaggctgtgggcatttggggttggccctaattgtctctatgtcagattgaggtggtgatgctgcaagtgcccggggcagggacttgatggcagcacatggaactctggtacctcttcctcagtcctgatatttgcttttttaacttctactaaaaaccccactgctaactgtgataggccacaacatgtttttatagatgtcaacaaatgttatcctggattgagaccacattttgactatttatcctggaaagtacacattttcacaggaaatcttgtcctttctaaggttcccaactaagctagtctcgttgtgggggggtcataattatttgttcttacttaccttactccttgttcatctttaaaaaaaaaatcaaataaaaaggattggaaagcaactttgcttctgcccaattctgctaaatgaaagttttctctgacagatcattttgattttgtattttcttttgtgacagaaacagtgggacaggagcatggaaatgaatgaaagtctttaaaagccttgagagagcgttttcaaggatcaggagagggcttagaaagaaaaggactctgagtggggctgcatgaaaagggggtaagtgaggactcttggggagggtctgaaaaaaacaagtagtttggcaaggagagcagaaaaataaaattccactgtgtaggcatttggagatttagcaagagcaacctagagtctgcccccagagacactgcacgttgtttctgacacagaggatgcactaattctatttcctgtgccacctgaaaaaatcataatttgagaagagaaactgttaggccatttctagtgaactatttttccaaaccctcacggaaccctgaacagggtgtgaatgagatcacaactactgctgctgctggttcagcctctctgtccactaataaaggcaaacccttcagcatggtcatatcctgccagccgttttcccccaaaagattaaattatgttcatcttggctcatctaacgccacatcttgagttcttaaggtatcacagccaactcagtcataccttactttatgcactgagtacgcattaaactctatttaggaaggaagagggaagcaaaggaagccagggatggttttgtcatgacctctctttgctttctgacctcccggaatccactctttggaagatgtgcagaaaacaatgtgacttccatttaccctgcctcagatctcccctccttcagactggctcccacccctggttaatggggtaacctgggtacgcctatttgttaaaggaatttgtgggaagtgaggggcaaaattgttggagcagagggaatagatttatgggagctttgttacccagtgactatcccagcattaatacttcagagtagccctgacgcttgtggaaacatttcaagggagctagaggcaatgttacagtggagatcagagaagggatggggcagtgagctcttgtccctaggggaaatctcttttcctccacgtgacaggagccagtgctccaacagcatcagaattacacttagccacaatgactgatgcgtgtgtgtgcctgtgcacatgtgtgtgagcgtgtgtgtgagcgcacgtgtgtaagggggtgatgatggaaacatgatatgcatccactatggggttgcgttgcaaattcacagctgcacccctcccaaagtcacatggcagaggggaaatggtcatagctttcctgtgtgatgtcctctccagggagcaccgacgactcaggcttgcctcagctctgcgaggcccagactccacactcctccctggggccggctctccttcctcttgactctcagatccccagcccatccacctccaagttctttttttgtttatttgttttgcttctgttttctgtaaatatctatttcttattttggacatgcagggatcaattgagattctggagtggggggaggggcggatgactgggtctttttattttttcctttctctcttggattttggtgtttgaacttgaaaaaaataattacaagtatatatataagcaaatgacttacctttaaacaaaagaaataagttgatttcattcttttgatttatcttgtttctcattggggtcgggtgggggtggggggtcttttgggtggagggcttttttgtgagctgtatagatttccagtttggacttgttcaaatgatgcaggaacaaaaattaaaacgaattaaaaaaaagacaacataaaaaaacaagaaaaactttgtgatgtataaaagctgtaaatagtcaaagattctttctcttttctaatggcaaattatttctgtcactttatattcaaaaaataaagaaacctaccacaaattatcagggttaaaaaaaatccagaatcagagtttttttcttggtctttgtgctttctttactgtgattccaaaaagattgttaaaagtgctgtttgggaaaaaccccttgcccagttggtttccaattgttggtaggagtcttggactggcgaatctacttgggttgggatctgtttctactatagctggtgctggagcccttggttacactcatctccccctcatgtattattctgaaacaaatcccataattatatggtttcatctgtaaacattacagtatatatctcttttactaaggactcttttttagtttaacaataccattgtgacatcataaggtagccataattccttgataagaaatatccagtgttcactaattgtctcaaatgtaatactgttttatggggtggtggtgggtttttttcccataagtcataaggtccatacaattagttgctatttctcaaatgtattttaaatctaaagatttgctttctaactttttcttgacatatacttgttaaaggaatagagcactttatcctttagaggttcccacagttggattttgctggttcttcccaatattaatgaagacaatgtaaattggtaattgttttactctttaatgcatacttccattgcttggaggtgtcagaaaagcaaaccagcccttgttttgctgattgtttcccaccccactcccagtcccagtcctgttactggctttatatatggattctaaatgatctctctttctataccttgattgctaaattatccaagttaaataatagtatctcccccttagctatcttggtaagaaaatagcatagacatatttagcttttcacatgccaatcatgaggcacatttcaacatcactttattaaaagccacatgctcctcctatagtcctagtactggaaaggaccttctagagaccatttagaagaactctgtctcatggccaaggagcctgggtgagctcatgtatggcagccctggctagaagccagcagggctaatccctagttccaggaatctcccaggataatgtattgttatctctttgaagttactgtctcagagagattatctgtgagggtctctcttgtactttcctttgtactgaacaaaaattcttgtttctccctgaacattccagaaagtagcaagctctaacataaagccagattcttcccagatatagtgattctctttacttctggagatacttccttaaaccccaaattttttttggacaacagaactgctttaacaataatctgaaaattatacagtaagtttgatttgaaaatctgagatttgtttaaaaaaaaaagggggaagacaagacttgaaatcttggctctgatttttctgttgtttttgtttttttgtttgttttttttttgtttgtttgttttttaagagggtcttgctctgtcatccaggctggagtggagaggtatgattacggctcactgcagccttgacctcccaggctcaagtgattctaccacctccgcctcctgtgtagctgggtactactggtgcataccaccacactgggctgattttgtattttttgtagagacggggtttcaccatgttgtccaggctgattctgaactcctgggttcaagtgatctgcctgcctcggcttcctatgatgctaggattacaggtgtgagccactgtgcccatcttggctctagttttaaataaggaagcttgcgagtatttatctggattatggtgggaacctccagtaggatatcatgaaagctttgatcatgatcacaacaccttcaataaaacaaagactccaatgacaagggtgagtgccagaacttcctgagactatgccaagtgtctgttctttatacagcctgcctcacccacacctggaatctcttaaatggattagctcagagcacctgtgtcctacatgcccttgtgccaccctgaagtccactgcaagggactatcagtaagaccagtctaatgaaaggctgagggagcacccggttgtgtccccatcagccaactgttccggaaagatgagcctccttggctgtcccaggattgacactcttcccctgcatacatcactaggaaggtagaacctaccctgaacacttgatttgaatatttctattcccctattcttttacaaatgcaaactaattctttcaaaaatataaatgatcctctgaaagaaatttcttgtggaattctggaatgaccaagaagatgggaagagaccaccagaaaagtggttctgagagtctgcagggcctgtcaaaaaaattatgccaaagctatcatttgtggcctgcatcaaatcatctagacttccgttttcttatcttgaaacccagatgttggtctatctgccctccccatcaaaggttacctggagcagtagttctcagttttacatagtggagtcatctgagtatttctgaaatgctgatgcctgagtctcatcccctagagagtctcattcaattgtcctgggtggctggaggggttaggggttgaaaacttgcccaggtgattttaatatacagccagaatgtgaaccactatgtatgtgcatctggggaaagcgggcctcctatttacttctaatcccattatatgtggcagctgtttgttgtcactctcctctcaccatggacaactattcacagcacagacagtcaccctttggaactccaggacctctttcctcttccatttggagctgaagaatggacataacggaagcaccattttatgattacagcctcgttctctaattctgcctatccccagcatacacggctagatatagacatactgcaaagctcctctatgtaaaggaaattctacacataaaatttaaacttggaatcga

SEQ ID NO: 8997 - DNA, 100 bp, Homo sapiens
  ENST00000636207
ctaaattcatgctgcttagatgacatctgtctaggaatcatgtgccaagcagagatggccatgtattacctgaattttggctgtgtctcccttcatcctt

SEQ ID NO: 8998 - DNA, 2688 bp, Homo sapiens
  ENST00000628166
tttctgcagtggaggggctacatggagattcagacaacagagcctggtggaccctctttcaccatcggcaaagctatttggttgctctggggtctggtgtttaacaactccgtacctgtgcagaacccaaaggggaccacctccaagatcatggtgtcagtgtgggccttctttgctgtcatcttcctggccagctacactgccaacttagctgccttcatgatccaagaggaatatgtggaccaggtttctggcctgagcgacaaaaagttccagagacctaatgacttctcaccccctttccgctttgggaccgtgcccaacggcagcacagagagaaatattcgcaataactatgcagaaatgcatgcctacatgggaaagttcaaccagaggggtgtagatgatgcattgctctccctgaaaacagggaaactggatgccttcatctatgatgcagcagtgctgaactatatggcaggcagagatgaaggctgcaagctggtgaccattggcagtgggaaggtctttgcttccactggctatggcattgccatccaaaaagattctgggtggaagcgccaggtggaccttgctatcctgcagctctttggagatggggagatggaagaactggaagctctctggctcactggcatttgtcacaatgagaagaatgaggtcatgagcagccagctggacattgacaacatggcaggggtcttctacatgttgggggcggccatggctctcagcctcatcaccttcatctgcgaacaccttttctattggcagttccgacattgctttatgggtgtctgttctggcaagcctggcatggtcttctccatcagcagaggtatctacagctgcatccatggggtggcgatcgaggagcgccagtctgtaatgaactcccccaccgcaaccatgaacaacacacactccaacatcctgcgcctgctgcgcacggccaagaacatggctaacctgtctggtgtgaatggctcaccgcagagcgccctggacttcatccgacgggagtcatccgtctatgacatctcagagcaccgccgcagcttcacgcattctgactgcaaatcctacaacaacccgccctgtgaggagaacctcttcagtgactacatcagtgaggtagagagaacgttcgggaacctgcagctgaaggacagcaacgtgtaccaagatcactaccaccatcaccaccggccccatagtattggcagtgccagctccatcgatgggctctacgactgtgacaacccacccttcaccacccagtccaggtccatcagcaagaagcccctggacatcggcctcccctcctccaagcacagccagctcagtgacctgtacggcaaattctccttcaagagcgaccgctacagtggccacgacgacttgatccgctccgatgtctctgacatctcaacccacaccgtcacctatgggaacatcgagggcaatgccgccaagaggcgtaagcagcaatataaggacagcctgaagaagcggcctgcctcggccaagtcccgcagggagtttgacgagatcgagctggcctaccgtcgccgaccgccccgctcccctgaccacaagcgctacttcagggacaaggaagggctacgggacttctacctggaccagttccgaacaaaggagaactcaccccactgggagcacgtagacctgaccgacatctacaaggagcggagtgatgactttaagcgcgactccgtcagcggaggagggccctgtaccaacaggtctcacatcaagcacgggacgggcgacaaacacggcgtggtcagcggggtacctgcaccttgggagaagaacctgaccaacgtggagtgggaggaccggtccgggggcaacttctgccgcagctgtccctccaagctgcacaactactccacgacggtgacgggtcagaactcgggcaggcaggcgtgcatccggtgtgaggcttgcaagaaagcaggcaacctgtatgacatcagtgaggacaactccctgcaggaactggaccagccggctgccccagtggcggtgacgtcaaacgcctccaccactaagtaccctcagagcccgactaattccaaggcccagaagaagaaccggaacaaactgcgccggcagcactcctacgacaccttcgtggacctgcagaaggaagaagccgccctggccccgcgcagcgtaagcctgaaagacaagggccgattcatggatgggagcccctacgcccacatgtttgagatgtcagctggcgagagcacctttgccaacaacaagtcctcagtgcccactgccggacatcaccaccacaacaaccccggcggcgggtacatgctcagcaagtcgctctaccctgaccgggtcacgcaaaaccctttcatccccacttttggggacgaccagtgcttgctccatggcagcaaatcctacttcttcaggcagcccacggtggcgggggcgtcgaaagccaggccggacttccgggcccttgtcaccaacaagccggtggtctcggcccttcatggggccgtgccagcccgtttccagaaggacatctgtatagggaaccagtccaacccctgtgtgcctaacaacaaaaaccccagggctttcaatggctccagcaatgggcatgtttatgagaaa

SEQ ID NO: 8999 - DNA, 100 bp, Homo sapiens
  ENST00000636855
acaaggagaggaagtgggaaaggtttcattacaagctcctggaaagcagaatctgtgtatcccctaccgtatcccctgcaggatctcatacagagactgg

SEQ ID NO: 9000 - DNA, 139 bp, Homo sapiens
  ENST00000636856
cttcagtgaagatggctaccagatgcacccgaaactggtgataattcttctgaacaaggagaggaagtgggaaaggaaagagacaagagggtgttttataagcccactccctcttccctgcctccacctaccagaaaac

SEQ ID NO: 9001 - DNA, 830 bp, Homo sapiens
  ENST00000630791
gcttcgtgggtttctcctccccccggagtcagggtgtgcgaggaaatctcggggcttcgctctatcgagagtgctcgtcaagggtgattcttgatcaccaccatccagtagtgctggcgtccgaatgcatatccttttgccttgcaaagaagagtcatgaacttcaaaacccccgagacggatcattaatcctgctttgcaggaaaggaaaaccctccattcccagccaccggccacccctctccgcagactgcaaccgcggaggcgctcggagccggaaggggacgctttgggaatgaccatgctccaccgagggacggagccggcccccagcttctccacacagagcctcctccactaacgctccaaaaaccaaaaaccgtaattgccagaagaagcgttaaaaatctattccagccactaacctcacatgcacacggaataattactctggattctgcattgtgagctgctctccataccctgaattacctttgaattaaatctttttttttttgaatttgcatctcttcaagacacaagattaaaacaaaatttacgctaaattggattttaaattatcttccgttcatttatccttcgtctttcttatgtggatatgcaagcgagaagaagggactggacattcccaacatgctcactcccttaatctgtccgtctagaggtttggcttctacaaaccaagggagtcgacgagttgaagatgaagcccagagcggagtgctgttctcccaagttctggttggtgttggccgtcctggccgtgtcaggcagcagagctcgttctcagaagagcccccccagcattg

SEQ ID NO: 9002 - DNA, 595 bp, Homo sapiens
  ENST00000627535
gcttcgtgggtttctcctccccccggagtcagggtgtgcgaggaaggggacgctttgggaatgaccatgctccaccgagggacggagccggcccccagcttctccacacagagcctcctccactaacgctccaaaaaccaaaaaccgtaattgccagaagaagcgttaaaaatctattccagccactaacctcacatgcacacggaataattactctggattctgcattgtgagctgctctccataccctgaattacctttgaattaaatctttttttttttgaatttgcatctcttcaagacacaagattaaaacaaaatttacgctaaattggattttaaattatcttccgttcatttatccttcgtctttcttatgtggatatgcaagcgagaagaagggactggacattcccaacatgctcactcccttaatctgtccgtctagaggtttggcttctacaaaccaagggagtcgacgagttgaagatgaagcccagagcggagtgctgttctcccaagttctggttggtgttggccgtcctggccgtgtcaggcagcagagctcgttctcagaagagcccccccagcattg

SEQ ID NO: 9003 - DNA, 115 bp, Homo sapiens
  ENST00000637875
caacatgctcactcccttaatctgtccgtctagaggtttggcttctacaaaccaaggtgtggcagagcatggcggatctgtgaacacagagtgatgtggcagtttagagttaggt

SEQ ID NO: 9004 - DNA, 4261 bp, Homo sapiens
  ENST00000293190
tgtccttgagccgcgggtgacggtggctctcgctgctcgcgccccctcctcccgcggggggagcctgatgccacgttccctatgaattatttatcgccggcctaaaaataccccgaacttcacagcccgagtgaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgcccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggagctgggcccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagctacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatggcaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagatgctgcaggcagcccgcgacatggtgaccacggcgggcgtaagcagctccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagctggaggacctgccgctgctcggtccggagcagctggcccggcgggaggccctgctgcacgcggcctgggcccggggctcgcgcccgcgtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattttgctggggggctgtctgtcctcaccttccaccctgtgccagccacggctcctggctctccggggcctgggggcctctggggcacaggggcaggactctggggctgggcacaggctacagagacagtgggggactggacgagatcagcagggtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattgggcttttctggcttctgccatgaaatcctggccatgggaccccagtgacagatgatgtcttccatggtcatcagtgacctcagtagcctcaaatcatggtgagggctgggcttttgctgtcctcttctcacgcagagttctgccaggagggtgtgctgtgggggtcagactcctgaggctctcccttccctggggctagccagttactggtcatggctgctgtgggcatggaggctggaacttgtggttgaggcagggccatcccgatccttgctctacctggctagagtttcttctcatcagagcactgggacattaaaccaaccttttacaaca

SEQ ID NO: 9005 - DNA, 6516 bp, Homo sapiens
  ENST00000584176
ccttgagccgcgggtgacggtggctctcgctgctcgcgccccctcctcccgcggggggagcctgatgccacgttccctatgaattatttatcgccggcctaaaaataccccgaacttcacagcccgagtgaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgcccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggtgcatgtccaaactcatgtcccctcgtgcctcaggcctggaaccaggctggggtcgggggtgctttggttctgggaagctgggattagacgggatgggcagggaggtgggggctgagggcatgatgtgggtgatggggagatggttatgggaatgacatcccatgttctagaggagagatattctgggctgacctcacattgtgtctggatgaggggtgggcagggtgcaggcccaccctctggctgtggggctcaggccccagccctcctcctctctgcttccctcagcttcctaggtcagggtgaagacccagagggccagccgggcatggaggtggtgccatgccctctgggcagtggtagttgacctgtagggtgagcaccagggaaccctgggagccctgggggaggcagaaacggccctgcccttgcagggctcaggggagaacgttccaaacacacattcatcagcagttacaactaggacaagcgttctgaaggaaagacacaggatgctgtgagggagctcactcatggctcatgcatagggtgttggccagggaaagtctctggagaaatgatgtctaggctgagggcctaagggcgagccggtggggagggggagaggcccaggcagagaagcaggtgggatgaaggccccaaggcgaggaaggagctcagagctttggaggaatagagggaaaagcctggagaaggaggcgggggcctggccacctgggaagacatttgggcttttccctaagcaagtgagcagacagggcagcgcaagccggctgtgacagtggccgtggtctgtgcctgccttagccctgtgagcttcctggccctgcccctgttgatctagccactcagggaagagcggaggagagttgagggaagagactgatctgattcgcctttgtttcattaatttttatatgaagaattttgagtatacattaaaaagtataaggaagactcatatatcccccattcgccctggccatccaccccagcctcaccagcacccccttccccttcttctgtgttaatttgaatcaaagcccaggcatcctcttattccatccataaatatttcagtatgtatccctggcagataagggcttaagaacgtaaaaccaccatacattatcacgtctaaaaaataataaaaactccttcaaatatccaggcagtgttcaaatttccccattgtttcataactgtcataagtgtttattttgcagcctgtttgctcgaattaagagccaaatcgggtccacacgtgccggttggttggtgtggcttctgagtttctctcaacctctgggcccctcctctgtctgtctctcttttttccttgcaatttgtttattgaagaaactgcgttgcttggcctctgaattttcccttatttgcttttttaaaagattgggacagtggcagcagtgagaccagttacgaggggactgcgctggccccggtgccagccggcagtgccttgggtttttgtggtggcagaggggtggagaggaggagctttcccaccctcagggcttcaaccagggtggcgtttccccgtcctcttggggccccggcataagatctcaggacattggctctcaaccctcatcgtgctcttaggaaatacagacgcctggctttgcacctctggaattcagattcagttggtctggggcagcgcttctcagtctagcgggctcaaggatcggctgaagagcttgtgagaatacagatgccaggcggcatacccagcgactccgatccagtcggtgtggggtgcgacctgagaatctgcatttctgacaaactccccagtggtgctgatgctgcgggtctgcgggccagcgtggtgggctgggggccgggcatgaccatgctactaggcagcggggaaccacattggggcgggagggaggcgcaggccagagggctcccggaatgcggagcatccgccggcgcaagggcgcctgggagctgatggaggggccgaggtcggggaaggggcgggaggaggggctcggccctcccgccccgctcaggccccgcccgcccccaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggagctgggcccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggtgggcacctgcccggggcataggggtagggaggtggggagcgcttcgggggagctggctggcagtgagtttgggctggccagccacacctcccactagctgcgtgcctggggccacattaccccacctgtctgggccttagtgtcctcatctgaacaaacagcaggtgtcagggtgtggcaaggatcgtggggccaatatagggaagcactttgaacaataaacacaatcaatgccacctgctgtcggtggcggcggtgaggcagaggcagggggtgcctggtccttggcagggctgcaggcatctctcccctctggcaggcacctactgaatgtcacctgggagggccgagacttctccttcagccctggtgggtacctggtccagcccaccatggtggtgatcgccctcaaccggcaccgcctctgggagatggtgagaagggggtgagcccaggggccctcagtgtcctcttattttgtccccgcctcctcttgtgcccacagctgagcagagagtccctctgtcccttatccaacccctcatcttccaggtctcagctgaaacaaacatctcctccactgggaagcctccaggtgccccggggtgggtgaggtgccctgctctgggctcccataacaccccggcttccctctactatagaacatttcaagcgctcctatctcctggtcctgcccctgcaggagtaacccatgaccatgctggccagacaggcttgtaaacaatatgcagggacaagtgcttgagtagacgtgtgcaaaagattgtgggattggagatgaggaacaggaattagttctgccttcaaaggaggaaactgggaaagaggtcccagaagatgggatatttgagctgggctgtggaggtttgagtaggagcccaccaggaagaggtgctagcctggaagagacagaggggcagaagggtttggagcatgaagggccttgagtgctcagctaaggacgttctgtcaaagtcaggggggaccagtacagtgagtgagacagggtcaggtctgggctttaggaagatgctgtgggtcagtgtggagctgtatgaacacagggacccgaggctgggggaggctgttgggagcagccctactctgacctgccccagcatccctaggtgagagagggagattcttggccctggcaggctccacctagagggtgggggctgtagggctggaggccccaggctgaggctgtcaccctccacaggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagctacacggccaacctggccgccttcatgatccaagagcaatacatcgacactgtgtcgggcctcagtgacaagaaggttgtggggccatagctgctgggggtgggggggggcactgagggtggggacaggccgtgagtgggcaggccctggacagtcgagtctggggaatttgacctggaggctggggcaggaagaagcttcagggcctgctgagaaggggttgggggctggggcaagagatggctcagggccaccggctgagaggccttgggtaagtctctccctgtcttgggcctcagagtctccatttggaaaacacaggagtggcctggacagcctttaagaccttctgctctgactatgcaagtccacactggggctgggctctggggtgggtttggggctttggtgcctggaaggctggaggaagggttgtgactggctgctgccctccgcctgcagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatggcaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagatgctgcaggcagcccgcgacatggtgaccacggcgggcgtaagcagctccctggaccgcgccactcgcaccatcgagaattggggtg

SEQ ID NO: 9006 - DNA, 2929 bp, Homo sapiens
  ENST00000347612
cgcgggcagggcggggacacgcggagcaaaggcacccggcaacctgaacccccaggtgcgtcccgcgaccctgcaaggagctgctgggaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgcccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggagctgggcccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagctacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatggcaggcgtcttctacatgctgctggtggccatggggctggccctgctggtcttcgcctgggagcacctggtctactggaagctgcgccactcggtgcccaactcatcccagctggacttcctgctggctttcagcagggtgggtgcccacccctccccacacaggccaaagttttaagggcacctacccagataagtccgggctggccatggcccatttccagaggtaaaaccaaggttctggcccggctcatggctcacacctgtaatctcaacactttgagaggcttaggccagtggatcccttgagtccagaagtttgagaccagcctgggcaacatggcgaaaacccatctctacagaaaataaaagaattagctggg

SEQ ID NO: 9007 - DNA, 615 bp, Homo sapiens
  ENST00000578159
cgaggctctgggacagacaccgcgagggaggcggccggcgcgggctctcgtcgcgggcgcagcgccccttcccctcggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggagctgggcccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccc

SEQ ID NO: 9008 - DNA, 1984 bp, Homo sapiens
  ENST00000584496
gagtcccgcttcttccccttccagctctgccccatctcctttgccccagcctagctctctccttcctgcgacctgggagaatcggagtgggcttccagagtagtggcatcttgcagatgctggcccgtgcccggctcccgggcttccagagcgcaaagggaagggtaggcagagagggcactgggcgagcaagacctggcgctgggccctggctgcgcaccagccgcctgcgccggtctctgggggcttcgcccaggatccccgacggcggggaggggaagccccgagtctcctgtttcctgcctacgcgggcagggcggggacacgcggagcaaaggcacccggcaacctgaacccccaggtgcgtcccgcgaccctgcaaggagctgctgggaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgcccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggtgcatgtccaaactcatgtcccctcgtgcctcaggcctggaaccaggctggggtcgggggtgctttggttctgggaagctgggattagacgggatgggcagggaggtgggggctgagggcatgatgtgggtgatggggagatggttatgggaatgacatcccatgttctagaggagagatattctgggctgacctcacattgtgtctggatgaggggtgggcagggtgcaggcccaccctctggctgtggggctcaggccccagccctcctcctctctgcttccctcagcttcctaggtcagggtgaagacccagagggccagccgggcatggaggtggtgccatgccctctgggcagtggtagttgacctgtagggtgagcaccagggaaccctgggagccctgggggaggcagaaacggccctgcccttgcagggctcaggggagaacgttccaaacacacattcatcagcagttacaactaggacaagcgttctgaaggaaagacacaggatgctgtgagggagctcactcatggctcatgcatagggtgttggccagggaaagtctctggagaaatgatgtctaggctgagggcctaagggcgagccggtggggagggggagaggcccaggcagagaagcaggtgggatgaaggccccaaggcgaggaaggagctcagagctttggaggaatagagggaaaagcctggagaaggaggcgggggcctggccacctgggaagacatttgggcttttccctaagcaagtgagcagacagggcagcgcaagccggctgtgacagtggccgtggtctgtgcctgccttagccctgtgagcttcctggccctgcccctgttgatctagccactcagggaagagcggaggagagttgagggaagagactgatctgattcgcctttgtttcattaatttttatatgaagaattttgagtatacattaaaaagtataaggaagactcatatatcccccattcgccctggccatccaccccagcctcaccagcacccccttccccttcttctgtgttaatttgaatcaaagcccaggcatcctcttattccatccataaatatttcagtatgtatccctggcagataagggcttaagaacgtaaaaccaccatacattatcacgtctaaaaaataataaaaa

SEQ ID NO: 9009 - DNA, 5093 bp, Homo sapiens
  ENST00000263269
ggacgccgggttccggtcctggcccccccgccatccccccaacagaacagggtcatgaaaagaggccgcccggcggggcccgcaggcgatgcgcggcgccggtggcccccgcggccctcggggccccgctaagatgctgctgctgctggcgctggcctgcgccagcccgttcccggaggaggcgccggggccgggcggggccggtgggcccggcggcggcctcggcggggcgcggccgctcaacgtggcgctcgtgttctcggggcccgcgtacgcggccgaggcggcacgcctgggcccggccgtggcggcggcggtgcgcagcccgggcctagacgtgcggcccgtggcgctggtgctcaacggctcggacccgcgcagcctcgtgctgcagctctgcgacctgctgtcggggttgcgcgtgcacggcgtggtcttcgaagacgactcgcgcgcgcccgccgtcgcgcccatcctcgacttcctgtcggcgcagacctcgctgcccatcgtggccgtgcacggcggcgccgcgctcgtgctcacgcccaaggagaagggctccaccttcctgcagctgggctcttccaccgagcaacagcttcaggtcatctttgaggtgctggaggagtatgactggacgtcctttgtagccgtgaccactcgtgcccctggccaccgggccttcctgtcctacattgaggtgctgactgacggtagtctggtgggctgggagcaccgcggagcgctgacgctggaccctggggcgggcgaggccgtgctcagtgcccagctccgcagtgtcagcgcgcagatccgcctgctcttctgcgcccgagaggaggccgagcccgtgttccgcgcagctgaggaggctggcctcactggatctggctacgtctggttcatggtggggccccagctggctggaggcgggggctctggggcccctggtgagccccctcttctgccaggaggcgcccccctgcctgccgggctgtttgcagtgcgctcggctggctggcgggatgacctggctcggcgagtggcagctggcgtggccgtagtggccagaggtgcccaggccctgctgcgtgattatggtttccttcctgagctcggccacgactgtcgcgcccagaaccgcacccaccgcggcgagagtctgcataggtacttcatgaacatcacgtgggataaccgggattactccttcaatgaggacggcttcctagtgaacccctccctggtggtcatctccctcaccagagacaggacgtgggaggtggtgggcagctgggagcagcagacgctccgcctcaagtacccgctgtggtcccgctatggtcgcttcctgcagccagtggacgacacgcagcacctcacggtggccacgctggaggaaaggccgtttgtcatcgtggagcctgcagaccctatcagcggcacctgcatccgagactccgtcccctgccggagccagctcaaccgaacccacagccctccaccggatgccccccgcccggaaaagcgctgctgcaagggtttctgcatcgacattctgaagcggctggcgcataccatcggcttcagctacgacctctacctggtcaccaatggcaagcacggaaagaagatcgatggcgtctggaacggcatgatcggggaggtgttctaccagcgcgcagacatggccatcggctccctcaccatcaacgaggagcgctccgagatcgtggacttctccgtccccttcgtggagaccggcatcagcgtcatggtggcgcgcagcaatggcacggtgtccccctcggccttcctcgagccctacagccccgccgtgtgggtgatgatgttcgtcatgtgcctcactgtggtcgccgtcactgttttcatcttcgagtacctcagtcctgttggttacaaccgcagcctggccacgggcaagcgccctggcggttcaaccttcaccattgggaaatccatctggctgctctgggccctggtgttcaataattcggtgcccgtggagaacccccggggaaccaccagcaaaatcatggtgctggtgtgggccttcttcgccgtcatcttcctcgccagctacacagccaacctggccgccttcatgatccaggaggagtacgtggatactgtgtctgggctcagtgaccgcaagttccagaggccccaggagcagtacccgcccctgaagtttgggaccgtgcccaacggctccacggagaagaacatccgcagcaactatcccgacatgcacagctacatggtgcgctacaaccagccccgcgtagaggaagcgctcactcagctcaaggcagggaagctggacgccttcatctacgatgctgcagtgctcaattacatggcccgcaaggacgagggctgcaagcttgtcaccatcggctccggcaaggtcttcgccacgacaggctatggcatcgccctgcacaagggctcccgctggaagcggcccatcgacctggcgttgctgcagttcctgggggatgatgagatcgagatgctggagcggctgtggctctctgggatctgccacaatgacaaaatcgaggtgatgagcagcaagctggacatcgacaacatggcgggcgtcttctacatgctcctggtggccatgggcctgtccctgctggtcttcgcctgggagcacctggtgtactggcgcctgcggcactgcctggggcccacccaccgcatggacttcctgctggccttctccaggggcatgtacagctgctgcagcgctgaggccgccccaccgcccgccaagcccccgccgccgccacagcccctgcccagccccgcgtaccccgcgccgcggccggctcccgggcccgcacctttcgtgccccgcgagcgcgcctcagtggaccgctggcgccggaccaagggcgcggggccgccggggggcgcgggcctggccgacggcttccaccgctactacggccccatcgagccgcagggcctaggcctcggcctgggcgaagcgcgcgcggcaccgcggggcgcagccgggcgcccgctgtccccgccggccgctcagcccccgcagaagccgccgccctcctatttcgccatcgtacgcgacaaggagccagccgagccccccgccggcgccttccccggcttcccgtcgccgcccgcgccccccgccgccgcggccaccgccgtcgggccgccactctgccgcttggccttcgaggacgagagcccgccggcgcccgcgcggtggccgcgctcggaccccgagagccaacccctgctggggccaggcgcgggcggcgcggggggcacggggggcgcaggcggaggagccccggccgctccgcccccgtgccgcgccgcgccgcccccgtgcccttacctcgatctcgagccgtcgccgtcggactcggaggactcggagagcctgggcggcgcgtcgctgggcggcctggagccctggtggttcgccgacttcccttacccgtatgccgagcgcctcgggccgccgcccggccgctactggtcggtcgacaagctcgggggctggcgcgccgggagctgggactacctgcccccgcgcagcggtccggccgcctggcactgtcggcactgcgccagcctggagctgctgccgccgccgcgccatctcagctgctcgcacgatggcctggacggcggctggtgggcgccaccgcctccaccctgggccgccgggcccctgccccgacgccgggcccgctgcgggtgcccgcggtcgcacccgcaccgcccgcgggcctcgcaccgcacgcccgccgccgccgcgccccaccaccacaggcaccggcgcgccgctgggggctgggacctcccgccgcccgcgcccacctcgcgctcgctcgaggacctcagctcgtgccctcgcgccgcccctgcgcgcaggcttaccgggccctcccgccacgctcgcaggtgtccgcacgccgcgcactgggggccgccgctgcccacagcttcccaccggagacaccggggcggggacctgggcacccgcaggggctcggcgcacttctctagcctcgagtccgaggtatgacgcggccccgggggccccaccgcccccttggtcagcgcaggccacggcccgagggggcgcccgcagtggacaggacccgcgtgggttgggaaggaaagcagtggaactggccggaccccgcctggagcagcgtcctgcgccccctggttctggaggaaccgcaagccggagaggatttggtccctcaactatcacccagcctgagaacgagggggcgggggccttggagcccaccggacttttttttaaacccgacaagggctttttaacgtcaccagatggggcgggaggtggggggttcacgccactcccgcgtcccacctccacgcccggggccgtggcccccacatcactgtgcagctccccggccccagccgcgcctccggggaagcccgtttttaacctttcatccattgggactcaaaactgtgagacgcgttcgccaaactgtgaccccagaccttggccccgccacacagaaacccctgacccagactgtgacatccgactcctaaaatggtcatccgactccagactgtgacccctgaccccaaactgtgacccgaaccccagactgtgccccgaccagactgtgacccttgacatcaaaccgtgacaccccctcctcctcttccaccctcggtcgcttttccctactctgacctaggacacgtccccaacggaagccccgccttcccttgcaccgcgatgaacccaacctccctgaagccaaaacttcccaccctgccgcacctccggaccaccccacttgccaccaagcacatcctctccaaatccaacccttatttgcgacccttcagtgatgacccagcagacctccaaaaagcctcctctgcccagatctccagccgggtctggggctgggttgcggaggggagggtctgggagtccacacttctccaccaacttcccttcccactctcttattccacattgcagtgtttggaataaaccatgtttttatgcctcctca

SEQ ID NO: 9010 - DNA, 4888 bp, Homo sapiens
  ENST00000398016
ctgctgctgctgcagccaccagagcagagagccttgagtacactttgccacagaaagcagtgagcaagaatgatagctgtctcttttaaatgccgttgtcaaattctgaggcgacttactaaagatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgcagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaagggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggagaaagctgacaggcgtgtgtctttgagaaacatgactctcttggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtgaccactatggtatatggtgggcaatgccctgccagtcccaacggtagagaaaaataggccgtcccccacaactctacaattaacatcagaggaaattttttacaagttcatcttactatcactttttaaaaagagaaacatctgtttgaaaatattctctgtgatgatttccttaattcactttgaaatcagtttcttactatgaagtcattaatgtaagaacttggccaacaaagcttttcttctcataggctggctctactaggggaactagtgtttggtaaactgctgggactaccacaatgggaggggtacaggtataaaattaagttatcttaaaatgtttcagcaatgatgcacgtaggagaccataataggtggtggtaaatgttttgcccacgtataggaatgattttaactaagatgtatgctattccctatgcaacaaattatcaaacaggatatgtcttgtgacctgttttttttttaaggacacatttttaatagctgaaaatctctgataatgaattagagtgtgtagtaaacatgagaattagttatattatcttatttttaaaattcaagactaagaacttcagagaatgaagagtctattaaaatgaggttcatcttaatgataggcaaaccaaactcatactgcttgacatgttttgaaaactggtaatattgagggtgtacagcacatgtacttaaaaatgacactggactatcttttgctctgagccatgccacttaccgaaattgtaaatacatttttcacaaatgcattgccaattattaccatccctcaaagcaataaattgtgacagttgctttaaatgtttgtcagcaactgttttcatttgttcagatattttgaatagctacactaataactgttattatttggtgaacataaaaaaataaatagatctgtatattgatggtagactctccatattgaaatgattattttccaaacattttcattttggtcaataattcaaactaccacttaggcaaagtattcgaacactgtgtcctttgtttaaggaaatataaaaaaaaaatcacctttctttttgtgcaaaaaaaatattatttcaatcacatttcagaaccgccagggcaagaaagtataaagcaggatcatgttaagaaaaaagaaaaaaagatcatgagtcacttaaatatgtatttttatttgtaacaaacaagtattaaactgtaaagtatttttgtacaaatttaatactttaatagcatggtatttatcgtctatgtatggttttggggaattcaaaattgttcaaatatttgtatggaaaaaaataaaaccctctaccaaatggaataaacagtgattttaaaaagccaaataaagaggatatgcatta

SEQ ID NO: 9011 - DNA, 2980 bp, Homo sapiens
  ENST00000538164
gtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgtgaaaattcagaggagcgacaggcaacttacctgggattcctgggccagcaaccacagcagccttcacaccaaccatcactataacacgtaccaccctgaccattgcagagtaccagccctgacattcccgaaagcacctcctccaaacagccctccagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaagggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtgacc

SEQ ID NO: 9012 - DNA, 757 bp, Homo sapiens
  ENST00000540854
cttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatgggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtga

SEQ ID NO: 9013 - DNA, 3410 bp, Homo sapiens
  ENST00000538211
gtgattgtgaagggggaggaggctgtggcaggcaggggtggtagtagtagtgaatgacacagatttgccagatgacatgtagcggacctctgcatcagccaagaggaattaagctttgtcactccccactgggactacctttctcctggtatgtgcgcaaggaattcatatgctgctgctgctgcagccaccagagcagagagccttgagtacactttgccacagaaagcagtgagcaagaatgatagctgtctcttttaaatgccgttgtcaaattctgaggcgacttactaaagatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgcagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaagggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaac

SEQ ID NO: 9014 - DNA, 863 bp, Homo sapiens
  ENST00000535323
ggtgtccattgagaagttcttaattcgtttctgtaagatatattcaaggtggcctcatgaatcccatctgttagagcccactgagtggaaagtgaatgcttaaaatgtagtttacagtaagcaaatgttagagcatttcaatttgcctcaaaactgccaggggtggtatttgattaaataaactcaatggcttaagtacttaaattggatttgagatgtgcattataaatgtcacttgcaaagcattttccagactttcatagttcaattagtacatccattttccagcctttggttttgccctgaagagactgtatttttacctcgcagaaggagaaatgtgcttactgttgagcaccaaatcctttccttagtccatggcttaattgtttctaaaaattgtcaatgccacaggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtgaatcatgtccgaaccagagactttgactgctgccttgttgtgcccctcatagcagaatccgggaa

SEQ ID NO: 9015 - DNA, 2843 bp, Homo sapiens
  ENST00000540433
agaagaggattaccacgagggctatgaggatgtctattattacgcttcagagcattttcgaagtaagcgcttctctccatcctccggttccttctcgcatgctggggctaacaataaaccttgtgtggagccttaatcttaaatgcaaaaggtttctcagatggtgttctctgtgagcagtctaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgcagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaagggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggagaaagctgacaggcgtgtgtctttgagaaacatgactctcttggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctg

SEQ ID NO: 9016 - DNA, 2491 bp, Homo sapiens
  ENST00000536215
taaagtgatagtgcagaaagaagactggatgtggaatgagaactgaagttagagttttaagtcctcacaaaaggatttgcctgatacctgtccttagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgtgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaagggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggcaacaatcatgtcggggagcacgatgagtttgaatcatgaggctccaacacctcgcagtcagctggggcgacaggccagcttccaggagcgcagcagctcgcggccgc

SEQ ID NO: 9017 - DNA, 558 bp, Homo sapiens
  ENST00000541299
gatacttaaactcctttcctgtctataaagcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggcaacaatcatgtcggggagcacgatgagtttgaatcatgaggctccaacacctcgcagtcagc

SEQ ID NO: 9018 - DNA, 200 bp, Homo sapiens
  ENST00000542021
ctctttcaatgatatgaagttaaaaccagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaat

SEQ ID NO: 9019 - DNA, 848 bp, Homo sapiens
  ENST00000543172
tgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtg

SEQ ID NO: 9020 - DNA, 573 bp, Homo sapiens
  ENST00000535002
actctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagtgaaaattcagaggagcgacaggcaacttacctgggattcctgggccagcaaccacagcagccttcacaccaaccatcactataacacgtaccaccctgaccattgcagagtaccagccctgacattcccgaaagcacctcctccaaacagccctccagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggc

SEQ ID NO: 9021 - DNA, 662 bp, Homo sapiens
  ENST00000545666
acactttgccacagaaagcagtgagcaagaatgatagctgtctcttttaaatgccgttgtcaaattctgaggcgacttactaaagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgt

SEQ ID NO: 9022 - DNA, 592 bp, Homo sapiens
  ENST00000542309
atgtccacctaaatttcaaagggctgaaaaaatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtg

SEQ ID NO: 9023 - DNA, 524 bp, Homo sapiens
  ENST00000539540
aatcttaaatgcaaaaggtttctcagatggtgttctctgtgagcagtctatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatc

SEQ ID NO: 9024 - DNA, 567 bp, Homo sapiens
  ENST00000541947
gatggaccgcttcctgggttttgtcaaggcgataagaagatctaggagaagaaaggggaaaaagtaccgaccagaagaggattaccacgagggctatgaggatgtctattattacgcttcagagcattttcgaaatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttgg

SEQ ID NO: 9025 - DNA, 600 bp, Homo sapiens
  ENST00000538373
gatggaccgcttcctgggttttgtcaaggcgataagaagatctaggagaagaaaggggaaaaagtaccgaccagaagaggattaccacgagggctatgaggatgtctattattacgcttcagagcattttcgaaagtctcgctctgttgcccgggctggagtgtggtggcttgatcctggttcaacctctgcctcccaggttcaaggagtctcgtgcctcagcctcctaagtacctgggattacagagtcatttctacagaaagaagcaggactgtttctcatcaggattctatgctcgtgtccagaactgtgaaatgaggagtggtgacgctgactatacctccttttaattgagacagtaaggccttctcaccttccccagcttactggggatgggaacagaacataagacaccagcagaaagagaagccaagagaaaatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaat

SEQ ID NO: 9026 - DNA, 5216 bp, Homo sapiens
  ENST00000359742
gtgattgtgaagggggaggaggctgtggcaggcaggggtggtagtagtagtgaatgacacagatttgccagatgacatgtagcggacctctgcatcagccaagaggaattaagctttgtcactccccactgggactacctttctcctggtatgtgcgcaaggaattcatatgctgctgctgctgcagccaccagagcagagagccttgagtacactttgccacagaaagcagtgagcaagaatgatagctgtctcttttaaatgccgttgtcaaattctgaggcgacttactaaagatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgtgaaaattcagaggagcgacaggcaacttacctgggattcctgggccagcaaccacagcagccttcacaccaaccatcactataacacgtaccaccctgaccattgcagagtaccagccctgacattcccgaaagcacctcctccaaacagccctccagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaagggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggagaaagctgacaggcgtgtgtctttgagaaacatgactctcttggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtgaccactatggtatatggtgggcaatgccctgccagtcccaacggtagagaaaaataggccgtcccccacaactctacaattaacatcagaggaaattttttacaagttcatcttactatcactttttaaaaagagaaacatctgtttgaaaatattctctgtgatgatttccttaattcactttgaaatcagtttcttactatgaagtcattaatgtaagaacttggccaacaaagcttttcttctcataggctggctctactaggggaactagtgtttggtaaactgctgggactaccacaatgggaggggtacaggtataaaattaagttatcttaaaatgtttcagcaatgatgcacgtaggagaccataataggtggtggtaaatgttttgcccacgtataggaatgattttaactaagatgtatgctattccctatgcaacaaattatcaaacaggatatgtcttgtgacctgttttttttttaaggacacatttttaatagctgaaaatctctgataatgaattagagtgtgtagtaaacatgagaattagttatattatcttatttttaaaattcaagactaagaacttcagagaatgaagagtctattaaaatgaggttcatcttaatgataggcaaaccaaactcatactgcttgacatgttttgaaaactggtaatattgagggtgtacagcacatgtacttaaaaatgacactggactatcttttgctctgagccatgccacttaccgaaattgtaaatacatttttcacaaatgcattgccaattattaccatccctcaaagcaataaattgtgacagttgctttaaatgtttgtcagcaactgttttcatttgttcagatattttgaatagctacactaataactgttattatttggtgaacataaaaaaataaatagatctgtatattgatggtagactctccatattgaaatgattattttccaaacattttcattttggtcaataattcaaactaccacttaggcaaagtattcgaacactgtgtcctttgtttaaggaaatataaaaaaaaaatcacctttctttttgtgcaaaaaaaatattatttcaatcacatttcagaaccgccagggcaagaaagtataaagcaggatcatgttaagaaaaaagaaaaaaagatcatgagtcacttaaatatgtatttttatttgtaacaaacaagtattaaactgtaaagtatttttgtacaaatttaatactttaatagcatggtatttatcgtctatgtatggttttggggaattcaaaattgttcaaatatttgtatggaaaaaaataaaaccctctaccaaatggaataaacagtgattttaaaaagccaaataaagaggatatgcatta

SEQ ID NO: 9027 - DNA, 9103 bp, Homo sapiens
  ENST00000324198
ggccggctacagcctgcggcgcgcgcagagcgctagtggggcgcgcggcgcgcgcgcggggcgggggcgcgcggaggggggggctgccccggggcggcccccccaggtcggggcgcggcgggcggcggcggcgggcgcgcgtcccgtccaggtccggagtaaccgccgccgccgccgccaaagctcgccaacatggcggacctggaggctgtgctggccgatgtcagttacctgatggccatggagaagagcaaggcgaccccggccgcccgcgccagcaagaggatcgtcctgccggagcccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatgactgccctgcctctgaccagtctgttccggggccccctcagccaggtgggaatgacggacacgtactatccaagtgtatgggattaactaatcattgaaggcattcatccgtccatcattggaaagatttacagtgattctgaaggacaggccgtggagttttaggtttcaggggcaagagcagttttcaaaagtctttgagtccagtgtgcacgagtcgacaagcagtacctggcatgcaggagcactcatgggtgagtccgtctcaggtctcgacaattagcagttgtgtgacagtcattctggttccttctgcctgaccctgggagacatatcagtaatggatgtacaaaagcaggtctgttttatgtcttagtataatttcagatgaattgtattgaaaaaatgctgaggaatgaatgtgtcaaaatgggttaactgtgtatattgactttcatgtcgtcatgcatctgtcatgaatgaatgatactttgcactgggctgtacgacagtgaggaccttagggcatgaagcctttttcctggtcccagcagcatctgccctgtgaagtttgttttctcccactgcctccaggccccactgatacccccaaatagatgctgggttatgagaaccagcgaaatcccccatgtcatcagtcttaaaaaaaaaattttacaaatccacgtatttgtcccattcttggagtagttttagtgtatgtctttacattaactactaacagtataaataacttgacatcgtaattgtctgcatcctgtccttgatatttttagcagttccaaatctttgtttttgtatttgtttgctgtgttcatgggcaaagtaagtactttttaatgcagttattttgagagtttggaagataattaccaaaagggtccattatttcataagagttactttgcaaaaaaaaaaatgtgggtttttttttttgtctatctcaactactagttggggtttaaattaacatacattttctactatctgttatttccagtgtgggaggagggatgtactacttacatgcattctccttatttaaaaaggaagaatagtattcaaattctgttgaaacacacacacacacacacacacacacacacacacactccagaagcagaaaagccattgttcttaaagagtgaatgtcttcccagccctggttaattatagctgtgactgatgccgttcccgtctgcatctcaagctcataggttctcagcatgtgcagttgaggatgcgctgggcctcatgcctgttctagatctccaggataaagggcctgctgttgactccaccagggtctgggcttagcgtctaatatctcgtacctagggcgtgagctgcacaaacgtgttcagaaagattattcaactttcccatacttgttctaaaattgagctgatccgcatctctttcaaaaactagaatttctgctctaagaatagaacataaggctccactcccttttagaaaagatatatgaattggaaaatgctctgaaagtccttttgcttcaaacaaaagtgtaaacttttacacttccccaactcacatttgatttgtaatgatatggttgagaagtacatctagatgtcatttattaaaagtgctttgtaagactagattgagctgtttctgagggcggtcaccagttgtgttggggtctggtttgagtgccttctgccaaaatgttgtgatggaggtgtttctgcgaccagacacaggataccgctgtgtctgcacccggttgcctgcatggccagaggaaaagtcagttggattaaacatcatggtatacttggctgttgtttttttttaattttttaattttttgggatagggcctcgctctgtcacccaggctggagaacagtgggatgatcatggctcactgcagccttgaattcctaggttcaagcaatcctcccacgtcagcctcctgagtagctaggactacaggtgcatgccacctttcctggctaatttattttttgggtagagatggggtcttgaactcttaggctcaagtgatcctccttccttggcctcccaaaatgctggaattagagatgtaagccaccatgcccagccatagtacttggatgttttagaaggttttccaagtattacataattcctagatgttcacccttattacactccaactattaaaaaggtcaaaattcagcctattttttttcattattttagattcctgtggttgggatattttaacattgatgagaaaaataattgaggttgatatttttacaaaatcatgcggtaataagtcttgatttcatgattcaaaagaatcaataaagcctaaaaataatagattactttaagctgctatgtaagatatatatggaataaattaaaaacctttgtgaattcaggtttattatttttaacctaaaacattctctttggttcattcatcccctcatgtcatgggggctcattggttttccttctttgtcatatttaagtatgatttttcaacaaaacttctagaagtcagcttattatgtcaccattcatgcaaagtgctcatgcctctgattggtccattcactgacgtgacaatttcaggtcctatgtttaaaaagaaggggctggccgggcacgatggctcacgcctataatcccagcactttgggaggccgagaggggcggttcacgaggtcaggagattgagaccatcctggttagcagagtgaaaccccgtctctactaaaaatacaaataaaaattagccgggcgtggtggcgggcgcctgtagtcccagctacttgggaggctgaggcaggagaatggcatgaacccgggaggcagagcttgcagtgagccgagattgcgccactgcactccagcctgggcgacagagcgagactctgtctcaaaaaaaaaaaggaggggggctaaatatccagtgagatgcactgaggaaaggaagcattttgctgaagacagcagcagcaacaaacaatggtctgtttgttgcaaacaagatgtagcttgatttctggtctgacatatgccatatacagatattagaaacgactgtttgaaggccacactggtcatctacaaagtaatgtttaccaattgacgacagggatttaactagattaaaaagatcaaagtgtggtttttctctgctttttaaaatttcactcggaatttgtagctgggccaattcaacacattttacttttcagtggaattgatttttctaatgtttcagaattttaacatatcaagaagaaaacaacgttctcaaagtctggcctctttagcatgatgtaaacctatagaaatgctttgaaatgtgctggtgtaagataagagttatcttgtatgatttaatcatatgcagtgttgtctcagttacgttcagggaaatgtttctgtgtcattcagagatgcttgatgaattaacacctcccaccctgagtgaggggttgacttgttgggagatgatttgggcttcactgggatctgtgacaggtgggggctgggctgggtgtcacaaagagaatagtggtagaaatcgggcgaaggaagaaagaagttactggtaaaaatcattacaccataaagcaccaaggaaataactgagttaaaataggtgaagtttcttttttcccccctgtaacaggagagttttccttatgataattattctgagacttggtcactttgtttttgaatgtggagctgctgaactcattcagaagccatttgctgcctatcaggactttctgaagaagttcttttgcctctgcctaccctctggcaccctcccatggaggcacaggggacccagagctaaagcattaccaggccatctccaaaacaccccgtgtgtgtgtgtgtgtgtgtgtgtgtgtgtgtgtgtgtgtgtgtgcactttgcagcccccgaggtggagaggcagtgtctggatcactgtgaatgcattgccccattggtcagttggggacactgttacaaatccactgaagtcctggtaaaactgtcaagagtaacaggcctcttctgttctaccctgctcacttccacggtgagttaccagcctgggcaacacagcaagaccccatctctacaaaaaaaatttttttaagtaattaaccgtttaaattttttcctaaagatttaacatgatttttccctcctatgtaaagtttactggagagacttgaattacttaaattcatgttaatatgatttttttttaatccaggtcacattttaacaaagtttattatgaaacaaatgaaatttgaactctaaaatggtactccttggcttcctcaagtcacaatgaactttatattttctttgtccttaaggactaagatagttgttttatttcagccgaatcacagagataaccactcctgcaggcccccacagctggcccaaaggggctgtctttctgacctggctgtgttagcactgattgagaaacgcaggctcccaaattttaaattgcctttattaaaaacacaaactacagaaaatgggttaagagtatacgcatttcatcaaacacatataggggaaaaaatccttcaatttagagttaaataactcagctttgtatagtagagttagcgctccagtatctaacaatctcagaatcatctctgaaaactggtaactatgcttccatttttaattttgtcctaaatatcagatgtctttgatgtaagggtagggaatggagaaatattttcaattgtgtatttgtattacaaagaacttgaaatttactttcttagttgattatattaaatgatgtatatattatatgtggtttataagctcaacactggccatttttttagttttattgttaaatggtatttttctatgtttaattataatagatctggctttttctggatagcataaagatcactgaactatatatatataagaaacaagagttctattttagcacaaaggcattttatattatttattgaatccataagtttgttttcgtcaaaaacattccatattatttctgctcctttttatttgtatagtttgttatttaaagaaatggcagtccttcctgttcttaatacaataaaattgaaataatgcacctagtaatgtggccgacatctcttctcaccaccatggactgttttcaacaacagttgatcttctggtctgtgctgagaggcgcatgcatgtctttcgtcacgtcgggcagcacacctgctgtgaaatactgctttcatctacctcttcagaaggcttcttgcttgttgacaagtaccgcaaaggctttattctggactggctatctcataaaaggatttctgtaagactttgcagtgtcattccctcagaacctaggtttgtttctaaagccacggtattgtccaggagcccctgtgtgtggggcaggtagctatccctcccatgtcattagtaatcctttaggatttaaggtacaactggacagcatcattccttccccttattgtgccaaatccccaccatcagccttgccattgccttaagatttgattattgcacccaattacctaaccactaaacagaaaggccaccttcactctttgaaaaaggcaagctgtgcttagaaacactgcttttaagagtagcacatttgagtgtgactttttccccccttcactatttcaaaatggttttgaaatggggtcttaaaggtaagcgccctcatacatgactgaaactttgtgagaggtcttatatttgaatggacccttaatgatttatgtgaaatagaatgaagtcctgtctctgtgagagaacgtgcctcctcactcatttgtctctgtctgttttcatagccatcaatatagtaacatatttactatattcttgaatacccttgaagaaagaaatccgttttctattgtgcattgctatacgaagtgaagccagtaaactagatactgtaaatctagatattgtacctagacaaaatatcattggttctatctctttttgtatctgttgtgccagggaaggtttataatcccttctcagtatacactcactagtgcacgtctgaaatagtatcccacgggagatgctgctccacgtctgaggtcacctgccctgtgtggggcacaccaccgtcagcaccaccgtttttacagttactttggagctgctagactggttttctgtgttggtaaattgcctatataaatctgaataaaaaggatctgtacaaaga

SEQ ID NO: 9028 - DNA, 657 bp, Homo sapiens
  ENST00000455558
accccggccgcccgcgccagcaagaggatcgtcctgccggagcccagtatccggagtgtgatgcagaagtaccttgcagagagaaatgaaataacctttgacaagattttcaatcagaaaattgataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggatgtttcaaaacaacgccacaaataacattcctccctccctgacccgtgct

SEQ ID NO: 9029 - DNA, 2873 bp, Homo sapiens
  ENST00000619906
ggggcgcgcggaggggggggctgccccggggcggcccccccaggtcggggcgcggcgggcggcggcgccgccgccaaagctcgccaacatggcggacctggaggctgtgctggccgatgtcagttacctgatggccatggagaagagcaaggcgaccccggccgcccgcgccagcaagaggatcgtcctgccggagcccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggatgaagaattgatactgaaggtttctatgtggctgacagtcactaaaccaacaagtcacaacttgaacccagcttttctgactctggagtcgggttctgcacagggaaaacaggaagcgctcagagctgtggagaatctgctggtgcacgtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatg

SEQ ID NO: 9030 - DNA, 2068 bp, Homo sapiens
  ENST00000398051
ttcagctaagccgttagcgccgagcccgcccgggagcgggtcgccggccgcggcgggcgcccctgccagtgagcccctgtccgaagtgagccacggcattgactcggggctgcccgggggcagggcactgaggagggagttgcgcgcgcgaggcgagggcgatggggccaagaagaaccggggcgatagcgcggcagcggtgacagctgggacccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaagaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggtggtgaaagggatctacctggacaccgcagatgaagacttctatgctcggtttgctaccgggtgtgtctccatcccctggcagaatgagggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaaca

SEQ ID NO: 9031 - DNA, 2136 bp, Homo sapiens
  ENST00000503518
cgcccgggagcgggtcgccggccgcggcgggcgcccctgccagtgagcccctgtccgaagtgagccacggcattgactcggggctgcccgggggcagggcactgaggagggagttgcgcgcgcgaggcgagggcgatggggccaagaagaaccggggcgatagcgcggcagcggtgacagctgggacccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaagtcctctgcatcccgccacaaaagcatcagttggtccagcccttcagcgggagacccccacaatcctctgtgcaatcctctgtctcggacctcatgtctcccttgcctgcgtctcaagagagctggcgacagagcctcggacctcaagtccctgtgctagccacggtagttcttcacaccccgtcactcttacggaattgctgatttcctctatttccttgcgtgatggagcagctctgctcggactgtgctccaggacagtgtaaatgccgactgaagatgccacagcagccggcgatgcatatttaaaggacagtctggagccgaaggtggcggccacgcttgtagtcccagctactctggaagctgaggtggaaggctcacttgggcccaggagagtccagcctgggcaaaacacagcaagaccatctctttaaaaaagtctaaaacaaagacttcatcttctcagtatttttgtgcaccaactcacactattttgaatagaagaactgagaatgggtgggaagagaatgggatctttttcccttaagataatcagggagtcccagagcagtatgcgttctcagcagccattttcagtggagcatttgactgtgcctcttatccctgactgtgaactccaaataggtcatggaaaataatcatccttagtggaagtcagattgaagctaagccagttttctttttacactaccttcctatctgcatgtaatttacaaaaaggaactataccaagccgccttccttataatgctgcagagattagataatgagataaatacaagtgctctataaatgctaaataacataaaaccagattctgtcacaaaacctaagaccacagtgatagtttgaaaaatgaaagttttggccgggcacggtggctcacagctgtaatcccagcacttttggaggccgaggcgggcggatcacaaggtcaggagattgagaccatcctggctaacatggtgaaaccccgtctctactaaaaatacaaaaattagccgggcgtggtggcgggcgcctgtagtcccagctacatgggaggctgaggcaggagaatggcgtgaaccctggaggcagagcttgcagtgagccgagatcgcgccacggcactccagcctgggtgacagagcgagactccgtctcgaaaaaaaaaaaaaagaaagttttaattttttccctgaaatatctcatattaactccacagtagtgtgattatgaggcctgtccccattgagtgagagtatttgctcctgtggtcagaaagcatcattatgtatagcttgattaatggttagagaagttgaatatataatattagatatacatggatacatgctgagtattggttataatttagggctttttcccaagttgatgactgtgtttgttactttaaagtatctcccaggaagtaccaggaggtgtcttcttggacacataacttcatggacagctccttgtttagcttcactggctcatatactagaaaattaacctttgaaatgaatgaacgtagcacaagagttatattctggtcctgagaagcgcaatgttgatttaatattattagtgagtccggtcatttcctggatttatttcaaatagaatcagtcagtctcaa

SEQ ID NO: 9032 - DNA, 2202 bp, Homo sapiens
  ENST00000398052
cagggcactgaggagggagttgcgcgcgcgaggcgagggcgatggggccaagaagaaccggggcgatagcgcggcagcggtgacagctgggacccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaaggaggatatggcaaaaaaagtggtcgtagtaaaaaatggaaggagatactgacactgcctcctgtcagccagtgcagtgagcttagacattccattgaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggtggtgaaagggatctacctggacaccgcagatgaagacttctatgctcggtttgctaccgggtgtgtctccatcccctggcagaatgagatgatcgaatctgggtgtttcaaagacatcaacaaaagtgaaagtgaggaagctttgccattagatctagacaagaacatacataccccggtttccagaccaaacagaggcttcttctatagactcttcagaagagggggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagac

SEQ ID NO: 9033 - DNA, 2013 bp, Homo sapiens
  ENST00000345167
ccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaagaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggtggtgaaagggatctacctggacaccgcagatgaagacttctatgctcggtttgctaccgggtgtgtctccatcccctggcagaatgagatgatcgaatctgggtgtttcaaagacatcaacaaaagtgaaagtgaggaagctttgccattagatctagacaagaacatacataccccggtttccagaccaaacagaggcttcttctatagactcttcagaagagggggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagac

SEQ ID NO: 9034 - DNA, 1971 bp, Homo sapiens
  ENST00000504933
ccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaaggaggatatggcaaaaaaagtggtcgtagtaaaaaatggaaggagatactgacactgcctcctgtcagccagtgcagtgagcttagacattccattgaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggtggtgaaagggatctacctggacaccgcagatgaagacttctatgctcggtttgctaccgggtgtgtctccatcccctggcagaatgagggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagac

SEQ ID NO: 9035 - DNA, 394 bp, Homo sapiens
  ENST00000507230
cactggatagaggagcgattgcagagaatcctcaaagttgcctttgaaattccctagctgaggaaattaaaagactgctctttctagtcttgaactcctgacctcaaatgatccacccgccttgcccttccaaattgttgggattccaggtgtgagccaccgcgcctggccaaaagaatgttcttgagctttatattttgacccaaattaggcaatagttaccttaaagaaaaatgatacagtcaaaatcattttggctttattaaagctcctcaaaaaactctagaattagggctttcttaagttactttttagcagaaacatttacggtattttgtacatatgtgtgcaaagttgcttattaacatttatgtcatggtcataaagactaatt

SEQ ID NO: 9036 - DNA, 515 bp, Homo sapiens
  ENST00000505271
agagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagac

SEQ ID NO: 9037 - DNA, 831 bp, Homo sapiens
  ENST00000509545
ggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgcctcatgccgtttactgtaaggacgtcctggatatcgagcagttctcggtggtgaaagggatctacctggacaccgcagatgaagacttctatgctcggtttgctaccgggtgtgtctccatcccctggcagaatgagatgatcgaatctgggtgtttcaaagacatcaacaaaagtgaaagtgaggaagctttgccattagatctagacaagaacatacataccccggtttccagaccaaacagaggcttcttctatagactcttcagaagaggggcagttttatacagtctgagagccacatggtgctaggtggaggccagccagaacaatgagaacaccctcgcagtgaggtttgttgctgggatgaagactgttctgatccaaaacaggactaccttccagcatttacaaacaggttcccgtgtcgctgacaaaatagtttacactgggctcagaaatcggcatcctgtggaaccttcgtcagatggcactcacagtgcatctctccctgctctggctcttagactc

SEQ ID NO: 9038 - DNA, 614 bp, Homo sapiens
  ENST00000511827
ggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgcctcatgccgtttactgtaaggacgtcctggatatcgagcagttctcggtggtgaaagggatctacctggacaccgcagatgaagacttctatgctcggtttgctaccgggtgtgtctccatcccctggcagaatgagggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagac

SEQ ID NO: 9039 - DNA, 428 bp, Homo sapiens
  ENST00000504308
tgggaggaggtcgatcaaagaatcaagaatgataccgaggagtattctgagaagttttcagaggatgccaaatctatctgcaggatgcctcatgccgtttactgtaaggacgtcctggatatcgagcagttctcggtggtgaaagggatctacctggacaccgcagatgaagacttctatgctcggtttgctaccgggtgtgtctccatcccctggcagaatgagatgatcgaatctgggtgtttcaaagacatcaacaaaagtgaaagtgaggaagctttgccattagatctagacaagaacatacataccccggtttccagaccaaacagaggcttcttctatagactcttcagaagaggggtaaaaagacttaaaaactaatatatgtgtgtgtatgtgaaaaaaaaaaaaacatactgactgcc

SEQ ID NO: 9040 - DNA, 2654 bp, Homo sapiens
  ENST00000392870
aaagcatccgagggagccggaggggaggagaatggagtgacagagacacgcggagggtggggggtgggggggagcgtgttgagggaggggggaggggggacacagagggaggaagaagcggcggcggcggcggcggcggcggcggctcctctttgcagagggggaaactcttgggctgagagcaggaataatgcggtaggcaaggcgggctgctggctcccccggctccggcagcagcggcggcagcccgagcagcggcagcagcagcggcagcaccccaggcgctgacagccccgccggccggctccgttgctgaccgccgactgtcaatggagctggaaaacatcgtggccaacacggtcttgctgaaagccagggaagggggcggaggaaagcgcaaagggaaaagcaagaagtggaaagaaatcctgaagttccctcacattagccagtgtgaagacctccgaaggaccatagacagagattactgcagtttatgtgacaagcagccaatcgggaggctgcttttccggcagttttgtgaaaccaggcctgggctggagtgttacattcagttcctggactccgtggcagaatatgaagttactccagatgaaaaactgggagagaaagggaaggaaattatgaccaagtacctcaccccaaagtcccctgttttcatagcccaagttggccaagacctggtctcccagacggaggagaagctcctacagaagccgtgcaaagaactcttttctgcctgtgcacagtctgtccacgagtacctgaggggagaaccattccacgaatatctggacagcatgttttttgaccgctttctccagtggaagtggttggaaaggcaaccggtgaccaaaaacactttcaggcagtatcgagtgctaggaaaagggggcttcggggaggtctgtgcctgccaggttcgggccacgggtaaaatgtatgcctgcaagcgcttggagaagaagaggatcaaaaagaggaaaggggagtccatggccctcaatgagaagcagatcctcgagaaggtcaacagtcagtttgtggtcaacctggcctatgcctacgagaccaaggatgcactgtgcttggtcctgaccatcatgaatgggggtgacctgaagttccacatctacaacatgggcaaccctggcttcgaggaggagcgggccttgttttatgcggcagagatcctctgcggcttagaagacctccaccgtgagaacaccgtctaccgagatctgaaacctgaaaacatcctgttagatgattatggccacattaggatctcagacctgggcttggctgtgaagatccccgagggagacctgatccgcggccgggtgggcactgttggctacatggctccagaggtcctgaacaaccagaggtacggcctgagccccgactactggggccttggctgcctcatctatgagatgatcgagggccagtcgccgttccgcggccgcaaggagaaggtgaagcgggaggaggtggaccgccgggtcctggagacggaggaggtgtactcccacaagttctccgaggaggccaagtccatctgcaagatgctgctcacgaaagatgcgaagcagaggctgggctgccaggaggagggggctgcagaggtcaagagacaccccttcttcaggaacatgaacttcaagcgcttagaagccgggatgttggaccctcccttcgttccagacccccgcgctgtgtactgtaaggacgtgctggacatcgagcagttctccactgtgaagggcgtcaatctggaccacacagacgacgacttctactccaagttctccacgggctctgtgtccatcccatggcaaaacgagatgatagaaacagaatgctttaaggagctgaacgtgtttggacctaatggtaccctcccgccagatctgaacagaaaccaccctccggaaccgcccaagaaagggctgctccagagactcttcaagcggcagcatcagaacaattccaagagttcgcccagctccaagaccagttttaaccaccacataaactcaaaccatgtcagctcgaactccaccggaagcagctagtttcggctctggcctccaagtccacagtggaaccagcccagacccttctccttagaagtggaagtagtggagcccctgctctggtggggctgccaggggagaccccgggagccggggaaggaggccgtccatcccgtcgacgtagaacctcgaggtttctcaaagaaatttccactcaggtctgttttccgaggcggccccggccggggtggattggatttgtctttggtgaacattgcaatagaaatccaattggatacgacaacttgcacgtattttaatagcgtcataactagaactgaattttgtctttatgatttttaaagaaaagttttgtaaatttctctactgtctcagtttacattttgtatatttgtatttaaatgaaagtgagactttgagggtgtatattttctgtgcagccactgttaagccatgtgttccaaggcattttagcggggagggggttatcaaaaaaaaaaaaatgtgactcaagacttccagagcctcaaatgagaaaatgtctttattaaatgtagaaagtgatccata

SEQ ID NO: 9041 - DNA, 5267 bp, Homo sapiens
  ENST00000369108
catcatctgaggtggacaggaagcccagccaagccactggggccgacccctcccctggactcacctgcatctgagccacacaccctccagccactacccatagcagttctgggggtgtgtcctgggaagactcccttctgctccccaaaaccccaaggcctggctcggggccactggagccgcaggcgggacatatgtgtgaccggccctctgcccctggcagccccgcgctgtgtactgtaaggacgtgctggacatcgagcagttctccactgtgaagggcgtcaatctggaccacacagacgacgacttctactccaagttctccacgggctctgtgtccatcccatggcaaaacgagatgatagaaacagaatgctttaaggagctgaacgtgtttggacctaatggtaccctcccgccagatctgaacagaaaccaccctccggaaccgcccaagaaagggctgctccagagactcttcaagcggcagcatcagaacaattccaagagttcgcccagctccaagaccagttttaaccaccacataaactcaaaccatgtcagctcgaactccaccggaagcagctagtttcggctctggcctccaagtccacagtggaaccagcccagacccttctccttagaagtggaagtagtggagcccctgctctggtggggctgccaggggagaccccgggagccggggaaggaggccgtccatcccgtcgacgtagaacctcgaggtttctcaaagaaatttccactcaggtctgttttccgaggcggccccggccggggtggattggatttgtctttggtgaacattgcaatagaaatccaattggatacgacaacttgcacgtattttaatagcgtcataactagaactgaattttgtctttatgatttttaaagaaaagttttgtaaatttctctactgtctcagtttacattttgtatatttgtatttaaatgaaagtgagactttgagggtgtatattttctgtgcagccactgttaagccatgtgttccaaggcattttagcggggagggggttatcaaaaaaaaaaaaatgtgactcaagacttccagagcctcaaatgagaaaatgtctttattaaatgtagaaagtgatccatacttcacctttgaaggattggttgtatttacccacatctatctctggagccatttcctcacattggtgtcacccttctgtcggcttggaacaatctgaattaaatgttccagacacacgtgggacttccccctcccagccagaatgtcctctcctggggccctcggagtcgcctaggctgagcccttctcctcgaggggcacgccgagccactgtcgcacccacctctgtctgctcttccttcaggaaggcggctggcacgcggatctaggtgtttgcagcctggtgggcgatgggcctctttccttctaagcaggtcctgactgctaaagccagtcatttgcaagaggtttgcattgggggatttttgctctatttttaacagaagcataggaccgtaaagatgtgtcatgaaaccccaagtgtcccaaagcctcggggcccacaggagcatcgggaagtgaggcagtgcgctcatcctgacggagcagcgtcgtgtctgtagcggggagggaggctggcccaggggcccggcatgttcctgaagcgttcacagggttttgagaccttcacagccccatcaatgtgctggcccatgtggcatggatggggtagtctctctgggcaaatgagaggcccaaggagagaccaagccaccaaagggctcaagacaaagtcactgttccttccccaggaaggtggggcagaggcaagatctatcggacatttcaaagtttcaggcaggagctcctagaggacttggtggctttgccagcccaggggcctctgaaggcagcccccagacccttgtagcagggctgtccatccccagggagcagctggccacctcctcctgcctcgaagaagtgaccaggggccaatctgctcccacctcccgtccaggacagggtgaacatttgacctcactgtcccctgcccggctgagtccctgatgtctgactgtgccacccagcagctgccagggtctctcaccatgtggaccctgccctagctgcagctgcacctcctgtcaaaagtgcagactcgcaggttccaccccaaaccacagaatgggaatgcctgggagcccacccctgctgtgggctctcagcggggctttgggggtgatcatcccaaacacatttctctggatgacgcaggcagcattggagcatgagccgtggggaggacagtcgtgagcacaccagctgtgaggcccggtttccatgcctaacccccggactctacccctgggtcctggggcgtaccgctaaaagggtcctggcctttgggactgatcattttgaggcccttttacaaagaaatgggggagaagaaatagctgggcttccctcaaatctttttaatgtgcagtatttttttgttcaagaccagctcttgttttatgaggctccttccattacctttcttgggctgaatgcaaaacaaatacagccacattcaagtcttccaaggaagtagaaaactctttgaatggtatcttaagatccttaagctcttgctgaacttcctttttcaatgaaaagaaggaccatcatcctaggatggtcaccagcccaagccaccaccccagccacccatccaggaggttggttccttttgcccagttcatagcagctcagtccttaccagatggattcttggtgttgggaagcagcctctttttattcctgaaaggcaatgccctgtccgtttgcagtagagaatccccagggagcaagaaagatgacagaagtgtggctgccgtgtttctaggtcatgagagctctggcgatactaccacaaggcctgcacgtggactctatgataacttgagtcttccatcatgtttgccaccagccctccctgagtgcccagaggagatgggggcagagtcacttggcctactaaagcctcctgttccttctggctcatgcattgctttgtggtaagagaaaggaagtctttagaacagcgcctgggaatcagcccttctccctactgagtccccagtcctgtcccttccctgactcgctcctcctccaaccttggtttctatagctgcatttttttttttttttttttttgagacaagatctcattgtgttccccaggctgaagtgcagtggcatgattctggctcactgcagcctcaaactcctgagtccaagctatcctcctgcctcagcctccgaggtagctgggaccataggcgtgcaccaccatactcagctaatttttaaaattttttgtagagatggggggggggtctccccatgttgcccaggctggcctcgaattcctgagcccaagctatcctcctgcctcagcctcccaaagtgctgaggttataggtgtgagccactgtccctggcctatacggtcattttttaaaagatattttaaaattaaaagcaaacaacactgtccacccatctacctgtccaggataaggcatatttggacggtgaacggatttactctcgttcatgcatttgagcgcttcacagaagagtctttcttgctccaggcatgacattttttttcaccagacgttcactgacttcgtgactttgaggtgagacatgggatctctcagaagcgtctctgcatctgcatttcaggagatgagctgctgtccctggtggacagaggcggtctctgccatggtcaccatgatgccctacaagtgtttattgagtcccctggggggcacccagaataccacccaaaatagcaagaagacccggtccccgccttgcggacgatgcactcacatgccacagcaacccattctcgcctcttccttggccgggaacccggggctctagggctgctcgctgctgctgtggcctgcgcagccacgggaggcttcctgaaaggcattgctcggaggggcgggggcggggaggcctagcctgccccacagacacagctgtgaggcctgggtcatacacataccagcaagcagctgccgagacaaatggtggtgggaagtcctgggaacacacacagcctttgcattgacagcacaagtaggatcagagcccaggtgagcccctgaggataccgaggccttccctccctgaggcccgcaagtctccatgcgtctcccgggagcctggccccgctgcagaaatcccttctcttcctccacaccctgtcctttccccaaaggctcgtgttatcagttccagctacccatcgactttcccaccgagccgctgccctcaaaacggagggggcaccgcagcctccttgagcctggcatcccaggccttgccaaaggggacggtggcttcctggataattggaaatctctgagaagaagaggaaacacctgagtgacactcagctgtcctctggggtcccctggtgtgcatgcacgtcctcctgaatacctgtacttccaagaggtggtctcctgttttcataacccaacactctgagataggatcttccaactttttagccccggctgtggaaagatagtgagtatgaagtctttgtgcatttggaagtgacatcgctgtgtggattatgaatacagagagctgccatcttcctgatcacaatagaccacgattgcaaagcctcctctcccagagaccccttctgcgcctgccctccccacccaccacccagctgttgaagctcagcgtgtgcaagtcagaccctgcacaggccgggggtgtctcacctggcctaaacgtaaaggcttgtgccggagacagtgattgaaaacatttgaaaagccagctctccctggcagagaaagacacttcccccccaaagtggaatttagatgtctttccctagtccatcaagaagtcatttttgtaacagtccctaagcgagtgttctcaattagaagagtttagtggcttttggtgttgttaaaataataagaatccttctagcatccaaagctttctaatttttttcagggagatttggacattaatgaatggaaacttccacagtggcggtcactcctgaaggcagcggcttctgttctcccgctgctgtaactctgtgtgttccgtctatcgcgtcacagtgccgctggatctagatggagccactgttgttgtttttaaaagagaaataaattccttaatggaa

SEQ ID NO: 9042 - DNA, 1515 bp, Homo sapiens
  ENST00000507005
agtgctgaagaaagagggcactagtgtacagcccagatcgcatccttgcaccgtctggattagagctgaggcgtctgcaagccgagcgtggccacggtcctctggccccgggaccatagcgctgtctaccccgactcaggtactcagcagcatctagctcaccgctgccaacacgacttccactgtactcttgatcaatttaccttgatgcactaccggtgaagaacggggactcgaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaaggtaagtttctctctctctctctctctctctctctctctctctctcacacacacacatgcacacacacactttgaaacacatatgcttgctttcac

SEQ ID NO: 9043 - DNA, 1654 bp, Homo sapiens
  ENST00000502405
gattagagctgaggcgtctgcaagccgagcgtggccacggtcctctggccccgggaccatagcgctgtctaccccgactcaggtactcagcatctagctcaccgctgccaacacgacttccactgtactcttgatcaatttaccttgatgcactaccggtgaagaacggggactcgaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaaggtaagtttctctctctctctctctctctctctctctctctctctcacacacacacatgcacacacacactttgaaacacatatgcttgctttcacaaaactagacttgctaactccaaagtgggagagatgtgcagtgctgagctgaacattagttctggatctcactgttaatgtgaatattggcatcttcctgctaaacaacagcagaacaaggctcaggagggaggattggttaagcccaggagtttgaggttacagtgagctatgattggtgccactgcattctagtctt

SEQ ID NO: 9044 - DNA, 6836 bp, Homo sapiens
  ENST00000492807
caggtactcaggtatgtctcaagtccatgtcctccaaacagactcagcatctagctcaccgctgccaacacgacttccactgtactcttgatcaatttaccttgatgcactaccggtgaagaacggggactcgaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaagaagaggcagccagaattctcgcccaccagccaatgtccgtcggcacatgtgcagctttgaaaacccccacactgcagtgaatgtttctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctgggagtggggggcctcgtcgggaggacaggagaccgctgctgctgctgccgctactgctgctgctgccttaagtaggaagagagggaaggacaccaagcaaaaaatgttccaggccaggattcggattcttgaattactcgaagccttctctgggaagaaagggaattctgacaaagcacaattccatatggtatgtaacttttatcacaaatcaaatagtgacatcacaaacataatgtcctcttttgcacaattgtgcatagatatatatatgcccacacacactgggccatgcttgccaaggaacagcccacgtggacatgccagtcggatcatgagttcacctgatggcattcggagtgagctggtggagccagacagagcaggtgcggggaagggaagggcccaggccagacccatcccaaacggatgatgggatgatgggacagcagctccttgctcagaagcccttctccccgctgggctgacagactcctcatcttcaggagactcaggaatggagcggcacaggggtctctcttcatccactgcaacccatccagtgccagctttgagattgcacttgaagaaaggtgcatggaccccctgctgctctgcagattccctttatttaggaaaacaggaataagagcaaaattatcaccaaaaagtgcttcatcaggcgtgctacaggaggaaggagctagaaatagaacaatccatcagcatgagactttgaaaaaaaaacacatgatcagcttctcatgttccatattcacttattggcgatttggggaaaaggccggaacaagagattgttacgagagtggcagaaacccttttgtagattgacttgtgtttgtgccaagcgggctttccattgaccttcagttaaagaacaaaccatgtgacaaaattgttaccttccacttactgtagcaaataatacctacaagttgaacttctaagatgcgtatatgtacaatttggtgccattatttctcctacgtattagagaaacaaatccatctttgaatctaatggtgtactcatagcaactattactggtttaaatgacaaataattctatcctattgtcactgaagtccttgtaactagcgagtgaatgtgttcctgtgtccttgtatatgtgcgatcgtaaaatttgtgcaatgtaatgtcaaattgactggtcaatgtcaacctagtagtcaatctaactgcaattagaaattgtcttttgaatatactatatatattttttatgttccaataatgttttgtacatcattgtcatcaatatctacagaagctctttgacggtttgaatactatggctcaaggttttcatatgcagctcggatggacatttttcttctaagatggaacttatttttcagatattttctgatgtggagatatgttattaatgaagtggtttgaaaatttgttatattaaaagtgcacaaaaactgagagtgaaaataaaaggtacattttataagcttgcacacattattaacacataagattgaacaaagcatttagattattccaggttatatcatttttttaaagattttccacagctacttgagtgtctaacatacagtaacatctaactcagctaataatttgtaaaatctttatcaatcacattttgccttcttttaatttttatgttcatggacttttattcctgtgtcttggctgtcataactttttatttctgctatttgctgttgtgtaatatccatggacatgtaatccacttactccatctttacaatccctttttaccaccaataaaaggatttttcttgctgttttgatttcttctattatttgtggaatgaattataccccccttaaatatctttgtttatgccttatgttcagtcatattttaatatgcttccttcatattgaagctgctgatttctcagccaaaaatcatcttagaatctttaaatatccattgcatcatttgttcagaatttaacatccattccaatgttggaggcttgtattacttatatttcatcatattctattgccaagtttagtcagttccacaccaagaatgaactgcatttcctttaaaaattattttaaaacacctttattgaaaagatctcatgactgagatgtggactttggttccatgttttcattgtaagaaagcagagagcggaaaatcaatggctccagtgattaatagatgggtttttagtaattgacaaattcatgagggaaagcatatgatctctttattagtgaatcatgcttattttttactcttaatgccactaatatacatccctaatatcacagggcttgtgcattcagatttttaaaaaattaggatagataaggaaacaacttatattcaagtgtaagatgatatcaggttggtctaagacttttggtgaacacgttcattcaactgtgatcactttattactctgaatgcctactattatcctgattatggggtctcctgaataaatagagtattagtccttatgtcatcattgttcaaaattggagatgtacacatacataccctataccaagagggccgaaactcttcaccttgatgtatgttctgatacaagttgttcagcttcttgtaaatgtgttttccttcggcttgttactgccttttgtcaaataatcttgacaatgctgtataataaatattttctattt

SEQ ID NO: 9045 - DNA, 3874 bp, Homo sapiens
  ENST00000355289
gaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaagtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctggg

SEQ ID NO: 9046 - DNA, 6622 bp, Homo sapiens
  ENST00000282753
gaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaattctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctgggagtggggggcctcgtcgggaggacaggagaccgctgctgctgctgccgctactgctgctgctgccttaagtaggaagagagggaaggacaccaagcaaaaaatgttccaggccaggattcggattcttgaattactcgaagccttctctgggaagaaagggaattctgacaaagcacaattccatatggtatgtaacttttatcacaaatcaaatagtgacatcacaaacataatgtcctcttttgcacaattgtgcatagatatatatatgcccacacacactgggccatgcttgccaaggaacagcccacgtggacatgccagtcggatcatgagttcacctgatggcattcggagtgagctggtggagccagacagagcaggtgcggggaagggaagggcccaggccagacccatcccaaacggatgatgggatgatgggacagcagctccttgctcagaagcccttctccccgctgggctgacagactcctcatcttcaggagactcaggaatggagcggcacaggggtctctcttcatccactgcaacccatccagtgccagctttgagattgcacttgaagaaaggtgcatggaccccctgctgctctgcagattccctttatttaggaaaacaggaataagagcaaaattatcaccaaaaagtgcttcatcaggcgtgctacaggaggaaggagctagaaatagaacaatccatcagcatgagactttgaaaaaaaaacacatgatcagcttctcatgttccatattcacttattggcgatttggggaaaaggccggaacaagagattgttacgagagtggcagaaacccttttgtagattgacttgtgtttgtgccaagcgggctttccattgaccttcagttaaagaacaaaccatgtgacaaaattgttaccttccacttactgtagcaaataatacctacaagttgaacttctaagatgcgtatatgtacaatttggtgccattatttctcctacgtattagagaaacaaatccatctttgaatctaatggtgtactcatagcaactattactggtttaaatgacaaataattctatcctattgtcactgaagtccttgtaactagcgagtgaatgtgttcctgtgtccttgtatatgtgcgatcgtaaaatttgtgcaatgtaatgtcaaattgactggtcaatgtcaacctagtagtcaatctaactgcaattagaaattgtcttttgaatatactatatatattttttatgttccaataatgttttgtacatcattgtcatcaatatctacagaagctctttgacggtttgaatactatggctcaaggttttcatatgcagctcggatggacatttttcttctaagatggaacttatttttcagatattttctgatgtggagatatgttattaatgaagtggtttgaaaatttgttatattaaaagtgcacaaaaactgagagtgaaaataaaaggtacattttataagcttgcacacattattaacacataagattgaacaaagcatttagattattccaggttatatcatttttttaaagattttccacagctacttgagtgtctaacatacagtaacatctaactcagctaataatttgtaaaatctttatcaatcacattttgccttcttttaatttttatgttcatggacttttattcctgtgtcttggctgtcataactttttatttctgctatttgctgttgtgtaatatccatggacatgtaatccacttactccatctttacaatccctttttaccaccaataaaaggatttttcttgctgttttgatttcttctattatttgtggaatgaattataccccccttaaatatctttgtttatgccttatgttcagtcatattttaatatgcttccttcatattgaagctgctgatttctcagccaaaaatcatcttagaatctttaaatatccattgcatcatttgttcagaatttaacatccattccaatgttggaggcttgtattacttatatttcatcatattctattgccaagtttagtcagttccacaccaagaatgaactgcatttcctttaaaaattattttaaaacacctttattgaaaagatctcatgactgagatgtggactttggttccatgttttcattgtaagaaagcagagagcggaaaatcaatggctccagtgattaatagatgggtttttagtaattgacaaattcatgagggaaagcatatgatctctttattagtgaatcatgcttattttttactcttaatgccactaatatacatccctaatatcacagggcttgtgcattcagatttttaaaaaattaggatagataaggaaacaacttatattcaagtgtaagatgatatcaggttggtctaagacttttggtgaacacgttcattcaactgtgatcactttattactctgaatgcctactattatcctgattatggggtctcctgaataaatagagtattagtccttatgtcatcattgttcaaaattggagatgtacacatacataccctataccaagagggccgaaactcttcaccttgatgtatgttctgatacaagttgttcagcttcttgtaaatgtgttttccttcggcttgttactgccttttgtcaaataatcttgacaatgctgtataataaatattttctatttatt

SEQ ID NO: 9047 - DNA, 3756 bp, Homo sapiens
  ENST00000507907
gctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaagaagaggcagccagaattctcgcccaccagccaatgtccgtcggcacatgtgcagctttgaaaacccccacactgcagtgaatgtgtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctggg

SEQ ID NO: 9048 - DNA, 6754 bp, Homo sapiens
  ENST00000361719
caggtactcaggtatgtctcaagtccatgtcctccaaacagactcagcatctagctcaccgctgccaacacgacttccactgtactcttgatcaatttaccttgatgcactaccggtgaagaacggggactcgaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaattctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctgggagtggggggcctcgtcgggaggacaggagaccgctgctgctgctgccgctactgctgctgctgccttaagtaggaagagagggaaggacaccaagcaaaaaatgttccaggccaggattcggattcttgaattactcgaagccttctctgggaagaaagggaattctgacaaagcacaattccatatggtatgtaacttttatcacaaatcaaatagtgacatcacaaacataatgtcctcttttgcacaattgtgcatagatatatatatgcccacacacactgggccatgcttgccaaggaacagcccacgtggacatgccagtcggatcatgagttcacctgatggcattcggagtgagctggtggagccagacagagcaggtgcggggaagggaagggcccaggccagacccatcccaaacggatgatgggatgatgggacagcagctccttgctcagaagcccttctccccgctgggctgacagactcctcatcttcaggagactcaggaatggagcggcacaggggtctctcttcatccactgcaacccatccagtgccagctttgagattgcacttgaagaaaggtgcatggaccccctgctgctctgcagattccctttatttaggaaaacaggaataagagcaaaattatcaccaaaaagtgcttcatcaggcgtgctacaggaggaaggagctagaaatagaacaatccatcagcatgagactttgaaaaaaaaacacatgatcagcttctcatgttccatattcacttattggcgatttggggaaaaggccggaacaagagattgttacgagagtggcagaaacccttttgtagattgacttgtgtttgtgccaagcgggctttccattgaccttcagttaaagaacaaaccatgtgacaaaattgttaccttccacttactgtagcaaataatacctacaagttgaacttctaagatgcgtatatgtacaatttggtgccattatttctcctacgtattagagaaacaaatccatctttgaatctaatggtgtactcatagcaactattactggtttaaatgacaaataattctatcctattgtcactgaagtccttgtaactagcgagtgaatgtgttcctgtgtccttgtatatgtgcgatcgtaaaatttgtgcaatgtaatgtcaaattgactggtcaatgtcaacctagtagtcaatctaactgcaattagaaattgtcttttgaatatactatatatattttttatgttccaataatgttttgtacatcattgtcatcaatatctacagaagctctttgacggtttgaatactatggctcaaggttttcatatgcagctcggatggacatttttcttctaagatggaacttatttttcagatattttctgatgtggagatatgttattaatgaagtggtttgaaaatttgttatattaaaagtgcacaaaaactgagagtgaaaataaaaggtacattttataagcttgcacacattattaacacataagattgaacaaagcatttagattattccaggttatatcatttttttaaagattttccacagctacttgagtgtctaacatacagtaacatctaactcagctaataatttgtaaaatctttatcaatcacattttgccttcttttaatttttatgttcatggacttttattcctgtgtcttggctgtcataactttttatttctgctatttgctgttgtgtaatatccatggacatgtaatccacttactccatctttacaatccctttttaccaccaataaaaggatttttcttgctgttttgatttcttctattatttgtggaatgaattataccccccttaaatatctttgtttatgccttatgttcagtcatattttaatatgcttccttcatattgaagctgctgatttctcagccaaaaatcatcttagaatctttaaatatccattgcatcatttgttcagaatttaacatccattccaatgttggaggcttgtattacttatatttcatcatattctattgccaagtttagtcagttccacaccaagaatgaactgcatttcctttaaaaattattttaaaacacctttattgaaaagatctcatgactgagatgtggactttggttccatgttttcattgtaagaaagcagagagcggaaaatcaatggctccagtgattaatagatgggtttttagtaattgacaaattcatgagggaaagcatatgatctctttattagtgaatcatgcttattttttactcttaatgccactaatatacatccctaatatcacagggcttgtgcattcagatttttaaaaaattaggatagataaggaaacaacttatattcaagtgtaagatgatatcaggttggtctaagacttttggtgaacacgttcattcaactgtgatcactttattactctgaatgcctactattatcctgattatggggtctcctgaataaatagagtattagtccttatgtcatcattgttcaaaattggagatgtacacatacataccctataccaagagggccgaaactcttcaccttgatgtatgttctgatacaagttgttcagcttcttgtaaatgtgttttccttcggcttgttactgccttttgtcaaataatcttgacaatgctgtataataaatattttctatttatt

SEQ ID NO: 9049 - DNA, 4153 bp, Homo sapiens
  ENST00000538487
ttttctgggtgtgtgttagggaggctatgttcctgaccctccccctctggggtgagaaggggtccccgccatgtcctcggggttggtaggaggagaggattggagctgttttctccttgatgccaagatacgccaagctaggagcattctgccctttccacagtcatccaccgagaacaggcctgcaggacgggacaaggatcagagccttcctgcaaccccggccactgcctgctgtctgtgggcctggactgtgcgggcaactgtgcttggcccgagtgacaaggaggtgggagagggtagcagcatgggctacgcggttggctgccctcagtccccctgctgctgaagctgccctgcccatgcccacccaggccgtggggccaggggcctgccagggctaggagtgggcctgccgttcatgggtctctagggatttccgagatgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgca

SEQ ID NO: 9050 - DNA, 3590 bp, Homo sapiens
  ENST00000374177
aatcccagcgctttgctggaggatcgcttgagcccaggaattcaagaccagcctgggcaacatggcgagaccctgtctgtcccaaaacaaaaaaacagattttaattggtttgggatgcggcctggacacagggaaattttaaagctctctaggtaactccaatgtgcgtcgaggttgcgaaccgccggcctgtcacacagagggagctcaggagatgctgagagtgggaggatgccggcttgggagcctggagttgcagcttcctgcggctggcgcgcccctccttgctcccctctacgcctctgcatcgcaccccacccctgtaccccaccttcctcccaccaaggaaacctcacctgccgcctcccgcccaggtcctttggattttgccggtgtgtgtgggtgcgcacaagaggcccctccctgccaggagagcaggtgagcctggccgcgcacgaatccgagggggcggccgcccagctgggaagcagccctgaaatagacccccgccgcccccgctgcctccttccggaatctgctcagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgagaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggtttt

SEQ ID NO: 9051 - DNA, 3471 bp, Homo sapiens
  ENST00000545715
agtaaacatgctcttctctagcacttgggacttcttggtgtcttaggagagacctgaggagctgtgtgtgtgtgtgcacgcacatgtgcgtgtgtgtgcatgcgtgtgtgtgtgttgtgtcctgtggccccaggccagcagggtgcctggcacagagcagccactccttccagagcgtaccctgttctctccagaatgcctgccgcctggccacttgcatcctctgaggactcagcccagtgtcactgcctttgggcagccttccctggcggccatctccctgcccacagggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagggagctcataggccactgactccacccaactctggccaggagaaaattcttcctttaactgagctggaccctgaccttcatgcctccctactggtcccatggtggacccctctgctcaccccatcctcaagcagtttgcttcgtccacatgtgatagactgatagttggacaccaaacttctgcctgtgttagtgggcttccagttacactgctgtgacaaagaggtcccagaactgagcagctcaaatcagacagatgtttgttgctctctgccgtaataggacatggtgggtgggtgggagtgaggacccaggatccttccatcttgttgctccattggctccctgaagattgaggctagatgacctcaatggttgttctgctcatggaagggaaaagagaagacgcatgggggaaagacccattttaattgaatgacatgggagctgcacacagtccttccatgtgtatttcatgaggaagaacacagtcagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacg

SEQ ID NO: 9052 - DNA, 3176 bp, Homo sapiens
  ENST00000609222
agagatgctggagctgtggacctgggcggtcctggtggaggagtgcctgacacatcccagtctttcaccgtggtgcctgtggacagatgaggagactgaggctcacaaaggaggtgacttgcccaaggtcacacagcgaggcagcttctcacctatgggagttggactttgagccctccttggaaaagggggcatggctgtgccccttggggctccttgctgggcctctgccctgcctgcctgggctcctcccggcctcccccacagatcactgttgacaaggttactgagtcagcatgtaaaacctgcaaaaataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagag

SEQ ID NO: 9053 - DNA, 3850 bp, Homo sapiens
  ENST00000609860
tctgatgtaatggggcaagtctgtgtagaaggctcaggtggccccagcctggacctccaggtcatttggaagcccagcggtgcccagcctaggtgtttggtttgaggcattgtgttgagttgagtgggacccagaggagggcagcccttagataccaagaccggcttcaagattaatccctcatgcttttccatcgactgccaccaggggcttctggggtcttattctctgggggtctccagctcctggactccagtagggcaggtaactgtgtggctttgggtaagccacttctcttctctgagcttcagtttcctcatccgtcaaaggcagtggctgacacaagcatggcccacagatgctctgtaccacgaggtcgggtgagatttaaatacgtgaatgacatctgtcccctgccagcacttgagaggcacatctggggctggggatggctgggacaaagtgctcccagggtctctgatggccacccagcctggtcgtgaatcctgacaacatcaagtactgaccctctcctgatggttccagccagtggccatgcacgctgctcctaccaagggcctggtgatgggcatggggcccagggacaggagtcctgagaagcacatggatatgggtgtagcagggactgatgcctcagggtgggctctattcccagctttaaccctccaagaaacattgtgagcgggttacaataaaaataatcaacatttactaagcactaggtaccggatgttgtctttatatgcattacctcacttgttttataacagttctatgaaataggtaataccattatttccactttataggtgatgtatgttcatcacagagaggtccagtaactgacctaaggtcacacagcagtaagtggcagagctgagatttgaacccaggcagtctagctcctaagcatgatgccgtgctgcttctagctgctatatggggaaactgaggctcagagtacttaagtgacatatccagggtcaccagctggtaagtggagccaagactggcactgaagctgtcctgactgcacagcccatatccagaggctgggatcccagggctgggagtcaggctggggagcctgggcagcacccagcccccatctcccggagtgtatgttgggagagtggtggggagactcaggttcccctgcccaccccaactaactggtgcccctcctgcagggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgc

SEQ ID NO: 9054 - DNA, 2983 bp, Homo sapiens
  ENST00000544773
agctgcccccaagccttggcagcctgagggtgcccatggggagccctgtctccgcttggctccttgcagtctgtggggcacagcgttcccctggagagaggctgttccttgtgggctcttactgtccatactcccagcctgccctggggggaacttcctgctatctcctcacctccaggcctgagctggaggaaggctgggcagaggagagctgccaggcaagacagatggcctgcagcctgggccagggaggggcaccactttgatctctgatgccctggggactcacgggctgcaggtgctaccagcccagcaccccggcacagcggggaggctgaggcagacacacgctcctggagagacatgtcatgtaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttg

SEQ ID NO: 9055 - DNA, 2574 bp, Homo sapiens
  ENST00000455714
aaatgccccagtccttccggctggctgcaagatggtgcaaactcttcccaagctatttccccatgatggcgccaagagaaaaaagaggacccttaggacttcagggccatgctttgggggtggaggacagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccac

SEQ ID NO: 9056 - DNA, 2978 bp, Homo sapiens
  ENST00000609278
gctttgctgtacttttctgggtgtgtgttagggaggctatgttcctgaccctccccctctggggtgagaaggggtccccgccatgtcctcggggttggtaggaggagaggattggagctgttttctccttgatgccaagatacgccaagctaggagcattctgccctttccacagtcatccaccgagaacaggcctgcaggacgggacaaggatcagagccttcctgcaaccccggccactgcctgctgtctgtgggcctggactgtgcgggcaactgtgcttggcccgagtgacaaggaggtgggagagggtagcagcatgggctacgcggttggctgccctcagtccccctgctgctgaagctgccctgcccatgcccacccaggccgtggggccaggggcctgccagggctaggagtgggcctgccgttcatgggtctctagggatttccgagatgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctag

SEQ ID NO: 9057 - DNA, 570 bp, Homo sapiens
  ENST00000609443
agagtgaccagatgctcagggcaggagtaggcagctggtctaaatccacagagcagaggaatagatctgattaatgagggagtcaagtcctgagggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggagggg

SEQ ID NO: 9058 - DNA, 555 bp, Homo sapiens
  ENST00000609915
agtggtaaggcctctggccgcctcggggttgatgtggacggccctagggccagcccacagcactgaactgacccctcctaacctgtatccagtcttgatgcacaccaggctgggcactttccagaaactacctctaacctccagggttccctcagtcactcagcaagcaccagtttggctcctaggccgtgccttgccctgttctaagcatggtggatatatagcagtgaagaaagagtccaatggcgcttggagtttttattctaatggggagacagacgatcaacaagacgagtgaatgatagaatatgtcagaacagaaatgtgcagaagaaacaaaacagacaataaaaagaacggaaagtgtgaggggaagggaaactgcaactgtgaagtggccagggacggcctgcttgcgcaggtgacatctgagccctcacatgagagggataggccgcacaggggaggggcagtgatcgggccattttacagatgggagaaccgaggcttagaggagaccgtgagcgaattgggcaggattcagcttatgagcag

SEQ ID NO: 9059 - DNA, 5822 bp, Homo sapiens
  ENST00000609973
gctcggtctccatcatggtggccaacatccttcgcctcttcaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggtgagggcaggtggcagcagggtgggcaccgggagccatgcaggtgtgggcaaagccacgggtcctgtcctgctggagaccttcccaggcgagcctgaccccaccctgggatccagagaggtgggtgctggtgagtgggtatgtgggcagggagacccacaggctagagcacaagctactgctatggggcactccttccctcccctctccatttcctgcatccattccacctgctagggatggctacctgggtgctttaacagagggctgaggccgtgagcttggggccggaccacttaggttctaatgctgttctcccacctactagctgtgtgaccccaggtgaatttcttaacctctctgggcctctgctgctaaaaaacaaatgagttaatgatacctgcctgatagtgtttgagaattcaatgcaggaatgtgcataaaaggcttagagtaaggtctggcgtgaaataggcacccagtaaatgtgggccacctcagcccctccctcctttctgtggtgagctcagagtacagagaagagctctgggctgtgtttggttctagtcttggcttaggctcagagagcccaacctgaggggagacacagctctgtcctcacggagccccaggataaggggagatacagccctgcctagaatctggcagggccctctagtccctgctggtcacctctccttcagagaggaggctgagagcagatgtggcccctgccaggtctcctcagatatctggcccgggctggcagagcctgctgtgccctcagactccccctcactggaccagccaaggctgctccgtgtacccagtccttcccaggaggcttcctcctattcctcaccagtgctcccaagccatttctcatgttctaacctggactccagagttgctgcaaaacagataccctcccaggccattggtgggtccctggagggatggaggagggcttctggaagatcatcacggcctcaaaagccaaaaggacaaactgcaatggttgtctcaggcagcgaaaggccagggaggggaggccctcaagccccatcctgacaccctcagagctgcacagaggcggcacccagtcccttgaggtgtgcaggtcccctgagttctggctctgaacgtgtatgatggccaccgctcagccagctcctggggaagcttctgagccaccgggccccactccctgacttcctgccccctactcccatcccaaagcctggtaagattaggctcccacaccgcacccagctatgtgcctcactccaggcctgctgtttttgaggacaccttcagctcagatggacccacattctgggagggggactgaaagcacttggccttttgtcccagcgaagaagcccctaggggagggctggaagggagctagactgacttccagagcaggctgcgggaagtggggtaggaggcgggggtcatttctggaaatccacacgcattttcagaagcaaacagaagtaaaaataaacccaggtgactctgcagggctggatgatcgggagctctggccatctcaggctggccggatgcagacgggtattaatagggtgtgggtgtgggttctgagagcagccttacctgccattagtggtgacctagggtgcgggggggctacaccagtgagcagagctggaaagcctcaggagttgggagatgatggagggtggggtgggatgagatggacaaggccagctcaggtgaaagctctggggcctggaaacatttgtttctccctggaagcccaggccctccagtcccagctggccgcctcctgcacaggcccagcagccaccccccagccctggagtctgtgccctggtcctcaccaacggaagggcctggacagtttgtagtatcacagcctctcacttgctgtgtgactgtgagcaagttccttgcctcctccctacctcagtctctttttgtgggagctgggttaggggaattctgcccattcctccttgtttttcccctctgagatgtctttgaggggccacttaattcatgcctccatgaagccctggctgagcgcttgctgtgggctcctcagccccgggctgggctcttgggtccctggtttgatttatattaccatcacaggcagactgggctgtgtgtgagcactgggcagctggctccacacccatctccctccatcacccactcccactcagggtgtggggagcagctctctgaaggacctggaattttggcacagagggcggtgaatgaagagggagctgtgggcagaaggcagcatgtgcagaggggtgagggcggcggttgtgtgatggtggatgcgtgtgagaatgggcaaggaatgtgggggtggatgagccaggaaggcatgcgtctcaggggaccggggctgggcagaggtggttgtggggcctgagtcagacgtggggcgggtgtggatctggaggggagaggtgtggtctttgcagggacagatgtaggcctggagaatcacgctgggcctgcagcaggcgtgggcccaggggcaggcaggttggatgaggcggtagccatgggtctatgagcaggtgagggcagcgggtagggggaatccatggcttggggtgaaagcatcggtgctgggacagttgtggaccctgggcttctgggggtgagggacgtgggcccaaagcaagtgtggccaggagtgggggcagtttcgtggacagacgcggctgggctgggctggtgtatgttcctacaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccagtgagcacgcgggccgggcagggccgggcgggctctaggaggagccggggagggccgagcctgggggcctgaggccgagagtctccctttgtctgtcgtcggccggccgtggcaggacgtgcagttgggcctgcacctggggtggagttgggaggcctggggcggggccttgaggggcggggccacagcagatttggggtgtggccttgagatccttgggagtggtaaggcctctggccgcctcggggttgatgtggacggccctagggccagcccacagcactgaactgacccctcctaacctgtatccagtcttgatgcacaccaggctgggcactttccagaaactacctctaacctccagggttccctcagtcactcagcaagcaccagtttggctcctaggccgtgccttgccctgttctaagcatggtggatatatagcagtgaagaaagagtccaatggcgcttggagtttttattctaatggggagacagacgatcaacaagacgagtgaatgatagaatatgtcagaacagaaatgtgcagaagaaacaaaacagacaataaaaagaacggaaagtgtgaggggaagggaaactgcaactgtgaagtggccagggacggcctgcttgcgcaggtgacatctgagccctcacatgagagggataggccgcacaggggaggggcagtgatcgggccattttacagatgggagaaccgaggcttagaggaggtgagtagagggacttgaattcccatagatagagggcggtagagcatgacttgctcctgggtctgagccctagggcccccgccccctaggtagccatcatggcgtgtccacttcagatacatccggacaggggtctttgcgcgccctgggtctgggtggctctgcggcaggacccagactcaataacattggggtgctctggtgcctctcagcctgagtggtgcctaatcgaggatgatgagttatctcctgtattctctcagacttgatcgtgcagtttgggcaaagggcgggggacgcgctgcatggagtcttagctcctccagagccaggggagaagtgagtgtgatgagggtgggtggggagcatgctgccctctggtggccagagcccacggggacttgcagccactggaccactggggacccagagaagctcacagccaaacccacctgatctgcagagtgagtgctagtgtgtgagtgtgcccagtgtggcagtgtttgtgtatacacctgtggcacatgactttgcatgtgtgtgagctggtgttcctgagagagaagggatgtgtgtgcctgtgtcttatgtggggcttatgtattcctgggtgagctaaacataaacattgctgtttactatgtatccactgtgttcagacactttaaagacatcatctttaaaatgtgaaagacatttcactctcacagcaactctaggaactcttaagattcctgcactctagacgaggatatggagagtcagagagaccaagtgacttgcccgaggctgctcagcaaatgcctgcatcaggcagtaatcacaatagaggtgtgagaagtgaaaagatgcctgggtgtggaggctgagccctcatgggtggggtgaccgtgcatcctgtctcccgtgttctggtgtaattattgagagcatccccttcggttcttggaagtgcccaggcgggatggaaaattgtatgggcaccctgatttagatcagcagacctagatcagatcaggggtgagggtggggatggatgaggtggggatggggtggaaagactggaagtggtggcaagatggacagctggtgcctcctggacccagtgcctaggctgtcgaggggtctgggttgtcaaggggaagggctttctggaatcttctctttgagagggacaggaggggagaaggctttggtcagttcctgtaggctctgtccagactcctagtccttggggcaggattcaagaaactctccagcagtcctaagggaggcgtttggtctgattgtcagctcaggtggggaaggaggactggagcagggttcagaagagcacagagctcggctgggcgtggtggcacatgcctgtaatcccagcactttggggggccgaggcgggcggagttcatctgaggtcaggagttcaagaccagcttggtcaacatgctgaaaccccgtctctactaaaaatacaaaaattagccgggtttagtggtgggcacctgtaatcccagctactcggggggccgaggtacgagaattgcttgagcctggggaagtggaggttgcagtgagccgagattgtgccagtgcactccagcctgggcaacagagtgatattctgtctc

SEQ ID NO: 9060 - DNA, 1004 bp, Homo sapiens
  ENST00000607916
gcaggacgggacaaggatcagagccttcctgcaaccccggccactgcctgctgtctgtgggcctggactgtgcgggcaactgtgcttggcccgagtgacaaggagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacggtgagtcaaacgcctggccgcagagtcatgccaggctcgggggtgtcccggcacagtgactgacccaccaggagctcccagccggggcctgatacaggctctgactgcctggctgttgccaggtgggcctcggcctcttctttgagcactgtggtttggtccatggcctcactgggctctgggtgactccggtcaacggcgactgtgaggcctttgcagacgtgggtgtgcagatgaggggactgttgacctccctggtgcaggagcctgcggggcggccgctctcctcacagcagagg

SEQ ID NO: 9061 - DNA, 6670 bp, Homo sapiens
  ENST00000535756
gcagtgcctgacacatcccagtctttcaccgtggtgcctgtggacagatgaggagactgaggctcacaaaggaggtgacttgcccaaggtcacacagcgaggcagcttctcacctatgggagttggactttgagccctccttggaaaagggggcatggctgtgccccttggggctccttgctgggcctctgccctgcctgcctgggctcctcccggcctcccccacagatcactgttgacaaggttactgagtcagcatgtaaaacctgcaaaaataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgcacccgggctccacatccactgagggtcctgccatgggaccacaggctcagcctgcagctggagggcttagacctagagggaagcgggaactgggctctggagacccagggcttgggggctgtggagactgctccctaggctgggatctagtgtggtgtggtgaggccttgggcatggaggggccagattcccaggtaaggggcagggacattgcaggaaattccaggaatcagcacctagtagtcccctaattagggggtatgctctgtcccctgccctgcagccctgggagggtaacatttctgccttgcctgtcctctgtctcacacccctcacacctgggactgcccttccacccctgcccccataacctgtgcctctctccttccagccaggaagtcctcttcttgagaagttagcttcccgggctgccagcactcatagccgtcccctcctgcttgtgttggctccaggctcgggtgctaagaagatgtgtgtctgtcctggagatcagtgtgttgttatgtgtccacgtgggcccacaagtgcacggcacaggcatggccgtgtggctgtgttggctgtgttggctgtgtgtctgtgtgcacgtccagcgcctccatgcgcatgcgtgcctgtcttgtttgcgtgtctgatcatctgtttgggccccggtggctcatgcagatgcctgtctcaggcccatggcgagtgttcacctcagctggcttccctggcaggttgggaggtgggaaacaggagcgcttaggggctgggctctggctggggtaaattatagagccagaaacacaatgaggccataggcagcagctggagcctgggctgcctgtgccgtcccctcctgccctgcccctgggtcctgcaccccctcccacctccaggctagctgacagcgctatggagcacagtggaagggactggaggaaccctaggcagggggccacgcagggacagagtatgagagtgtgtgtataactgaggctgggacattgaatcatgccaggtatgtcttctccatcagcccactcttactcctggcctgggcatctcacacatctgtgcataggaaatctcttcttccctggggtctgtgtgcagcacctagtagatgctcaataaatgtttgtgtgagggaaggagacaggaaaggaagtgtctcgctgatcatcttgcggaatggttcctaagacctctgcccaggaaagattccacccagtgctccagcccggtcaggcagaactaggttgccagatcaagggtatctcccaaaagcttccagggcagttgggggtgggggggtggggggtagggatggggaatgcagaagcgggtgcagccagctctcccccagggtgactctggcagcacccccatcctgggcaccctgcctgctctgtggctcacgcccctcctgaagtgactgatgctctgaggcccaaggctaggtccagggcagggcctgcaggggtttcatgctcagtccaggacttgcctaggtccccctacatctgtggggcccccatctaggttctaacaggagaatcacctctccaagggggatgctgcccctcggctccccttggctctcaggaggggccctcagggactaccagtcccctgccagtgggaagaaatagccctgccctcagggagcttccagtgtgatgggggagatacagcagactgtgtcccaaagtaaaatgactgttagaatgaggtgggtggaggagggaagccttgggtgggtgtgactttgggcatctgagcctggggtgcagaggtgggctctgtgggcctgaggtggacaggagggaaccaggccctagcaagacttttgccagctagacctgctgcagcagttgggagggtgggtgctgctggagtcctgggtccatcacctagaaggctcaggccagtgcagccagggctggggcccacagctggcctgggtgggacctgccctgatgcccatggcaggagggacgcctggcccttcacaattggcttggctgctcacctttgctctcatcctcaattattaatgactggagaaagctgctaagtatcttcagaatgttagatttcaacaagatggggggttcagggtccctggcaccctggatagggagccagcggcccctagagacctttgctgtgtgcagggggtatgtgctcacccccgtggcctcagcctcctcaatgtctgaatgaaggattgggctagcagacatcccaccccacagcacactttctaaccagcaggggaacttctagacaatagagacgctgggctccctccagaacactggacctgaacttctggggggagggctgggcacgggcatattttaaaagctccccagcagatgggccgtgcagtcaagtgggccaagagtggcaccagactttggggcttgtgaagtcaggagggagcaacagtgcccactcgagcttgcctggggctcaagcccaaggctgggctgctgccagcctgagcagacacccaggagcttccaggccagctggatgcacagggcacctttgtggaactcctaggaccctggggagacccacctcaggagcagagtctcaggtcccttccggctctgaggggctgttctgagctctaatgtcttatggtctgcccctcccatccttacttctcaggccctggaggcagaggcatagagccaggcaggacagaggtctcagtgggccacatgccagctgcccccacactgcctcagcctccaggcctccaaggggtcctggggagcccctgagaagatgctgagcctgcataaggctgggcgcccctctttctgacaccctcactggctccacggctcccccttcccatcccaggtttccatctgcccactgaacagggaggggaaactgaggcactcccctggcactgagggctccttctgtcatcctgcctgccctggatggtcctggctgcccctcagggcttggccctggcactgtgagcctcacagggctcagacccccacccccaacccagcactaaatggcactcggcaccagaatctcacttcagttggcaaaagcagcaattagcatgtaatgaggcttcttgctttatttttaggtaacctccaaggccctgcctgtgtaattcagcccgccattgctcggtggataattaaagcatgtcaccat

SEQ ID NO: 9062 - DNA, 7275 bp, Homo sapiens
  ENST00000374181
agtgacgcaccagggtgggagtagcgcgcccctctgcgtccctgtgctttgctgtacttttctgggtgtgtgttagggaggctatgttcctgaccctccccctctggggtgagaaggggtccccgccatgtcctcggggttggtaggaggagaggattggagctgttttctccttgatgccaagatacgccaagctaggagcattctgccctttccacagtcatccaccgagaacaggcctgcaggacgggacaaggatcagagccttcctgcaaccccggccactgcctgctgtctgtgggcctggactgtgcgggcaactgtgcttggcccgagtgacaaggaggtgggagagggtagcagcatgggctacgcggttggctgccctcagtccccctgctgctgaagctgccctgcccatgcccacccaggccgtggggccaggggcctgccagggctaggagtgggcctgccgttcatgggtctctagggatttccgagatgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgagaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgcacccgggctccacatccactgagggtcctgccatgggaccacaggctcagcctgcagctggagggcttagacctagagggaagcgggaactgggctctggagacccagggcttgggggctgtggagactgctccctaggctgggatctagtgtggtgtggtgaggccttgggcatggaggggccagattcccaggtaaggggcagggacattgcaggaaattccaggaatcagcacctagtagtcccctaattagggggtatgctctgtcccctgccctgcagccctgggagggtaacatttctgccttgcctgtcctctgtctcacacccctcacacctgggactgcccttccacccctgcccccataacctgtgcctctctccttccagccaggaagtcctcttcttgagaagttagcttcccgggctgccagcactcatagccgtcccctcctgcttgtgttggctccaggctcgggtgctaagaagatgtgtgtctgtcctggagatcagtgtgttgttatgtgtccacgtgggcccacaagtgcacggcacaggcatggccgtgtggctgtgttggctgtgttggctgtgtgtctgtgtgcacgtccagcgcctccatgcgcatgcgtgcctgtcttgtttgcgtgtctgatcatctgtttgggccccggtggctcatgcagatgcctgtctcaggcccatggcgagtgttcacctcagctggcttccctggcaggttgggaggtgggaaacaggagcgcttaggggctgggctctggctggggtaaattatagagccagaaacacaatgaggccataggcagcagctggagcctgggctgcctgtgccgtcccctcctgccctgcccctgggtcctgcaccccctcccacctccaggctagctgacagcgctatggagcacagtggaagggactggaggaaccctaggcagggggccacgcagggacagagtatgagagtgtgtgtataactgaggctgggacattgaatcatgccaggtatgtcttctccatcagcccactcttactcctggcctgggcatctcacacatctgtgcataggaaatctcttcttccctggggtctgtgtgcagcacctagtagatgctcaataaatgtttgtgtgagggaaggagacaggaaaggaagtgtctcgctgatcatcttgcggaatggttcctaagacctctgcccaggaaagattccacccagtgctccagcccggtcaggcagaactaggttgccagatcaagggtatctcccaaaagcttccagggcagttgggggtgggggggtggggggtagggatggggaatgcagaagcgggtgcagccagctctcccccagggtgactctggcagcacccccatcctgggcaccctgcctgctctgtggctcacgcccctcctgaagtgactgatgctctgaggcccaaggctaggtccagggcagggcctgcaggggtttcatgctcagtccaggacttgcctaggtccccctacatctgtggggcccccatctaggttctaacaggagaatcacctctccaagggggatgctgcccctcggctccccttggctctcaggaggggccctcagggactaccagtcccctgccagtgggaagaaatagccctgccctcagggagcttccagtgtgatgggggagatacagcagactgtgtcccaaagtaaaatgactgttagaatgaggtgggtggaggagggaagccttgggtgggtgtgactttgggcatctgagcctggggtgcagaggtgggctctgtgggcctgaggtggacaggagggaaccaggccctagcaagacttttgccagctagacctgctgcagcagttgggagggtgggtgctgctggagtcctgggtccatcacctagaaggctcaggccagtgcagccagggctggggcccacagctggcctgggtgggacctgccctgatgcccatggcaggagggacgcctggcccttcacaattggcttggctgctcacctttgctctcatcctcaattattaatgactggagaaagctgctaagtatcttcagaatgttagatttcaacaagatggggggttcagggtccctggcaccctggatagggagccagcggcccctagagacctttgctgtgtgcagggggtatgtgctcacccccgtggcctcagcctcctcaatgtctgaatgaaggattgggctagcagacatcccaccccacagcacactttctaaccagcaggggaacttctagacaatagagacgctgggctccctccagaacactggacctgaacttctggggggagggctgggcacgggcatattttaaaagctccccagcagatgggccgtgcagtcaagtgggccaagagtggcaccagactttggggcttgtgaagtcaggagggagcaacagtgcccactcgagcttgcctggggctcaagcccaaggctgggctgctgccagcctgagcagacacccaggagcttccaggccagctggatgcacagggcacctttgtggaactcctaggaccctggggagacccacctcaggagcagagtctcaggtcccttccggctctgaggggctgttctgagctctaatgtcttatggtctgcccctcccatccttacttctcaggccctggaggcagaggcatagagccaggcaggacagaggtctcagtgggccacatgccagctgcccccacactgcctcagcctccaggcctccaaggggtcctggggagcccctgagaagatgctgagcctgcataaggctgggcgcccctctttctgacaccctcactggctccacggctcccccttcccatcccaggtttccatctgcccactgaacagggaggggaaactgaggcactcccctggcactgagggctccttctgtcatcctgcctgccctggatggtcctggctgcccctcagggcttggccctggcactgtgagcctcacagggctcagacccccacccccaacccagcactaaatggcactcggcaccagaatctcacttcagttggcaaaagcagcaattagcatgtaatgaggcttcttgctttatttttaggtaacctccaaggccctgcctgtgtaattcagcccgccattgctcggtggataattaaagcatgtcaccat

SEQ ID NO: 9063 - DNA, 4475 bp, Homo sapiens
  ENST00000305432
acaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggaggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaagatgccaagggcaccccttaatggaaacacgagatcagtagtgctatctcatgacaaccgacgaagaaaccgacgacaaatcttttggcagattttcttctagtggccttagaaaacatgggcttttaagaaacacggctgatatctttgagggctgacaaggcgtctcttcaaacagttccataccaagtgctttgctctagggaagcagtgcgtgtgaaacagcgtaacggagggtgaagagcatagttaataagcaactgtaaaaagttttatttgtttactttaattcttttcccagaagagtctttgattcaccaaacatgaatgtacattttctaacaaactcaaaatctgggaccaaaacatcaacttttttctttcttttttctttctttttgttttttctttcctgtaaagaccttgaaaagcagtaacttgggtccagtatttacggaggcgttgtgaatgtgtcccatgcataacacactactggatagtgagtgctgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatc

SEQ ID NO: 9064 - DNA, 4571 bp, Homo sapiens
  ENST00000305447
acaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaaggtacaaagacaggagactggcccagcacaagtcggaaatagagtgtttcacccccaaagggagtatggggaatggtgggagagcaacaatgagcagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggaggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaagatgccaagggcaccccttaatggaaacacgagatcagtagtgctatctcatgacaaccgacgaagaaaccgacgacaaatcttttggcagattttcttctagtggccttagaaaacatgggcttttaagaaacacggctgatatctttgagggctgacaaggcgtctcttcaaacagttccataccaagtgctttgctctagggaagcagtgcgtgtgaaacagcgtaacggagggtgaagagcatagttaataagcaactgtaaaaagttttatttgtttactttaattcttttcccagaagagtctttgattcaccaaacatgaatgtacattttctaacaaactcaaaatctgggaccaaaacatcaacttttttctttcttttttctttctttttgttttttctttcctgtaaagaccttgaaaagcagtaacttgggtccagtatttacggaggcgttgtgaatgtgtcccatgcataacacactactggatagtgagtgctgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatc

SEQ ID NO: 9065 - DNA, 450 bp, Homo sapiens
  ENST00000449371
ctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggtagagggacaaagaaggaagagatgcgtaagagggatcagacattgatgttatcttttatgaggttcaagctattctcatgcctcagcctccagaggagctaggattacaggcatgtaccacacccaggaagttatacagatacacgttcctctgaacttcgccaatacttacagtattgtacaatacttatttgtgacttctcatcaacaccccaactggttagatgctgttatttttactggttgtatattaagacaataaaaaatttcgtacttgggtagcaaagaa

SEQ ID NO: 9066 - DNA, 1268 bp, Homo sapiens
  ENST00000393294
cgcgagagagcgagcgccaccgccgcgggccccgcagccgttctgcctgctgtcaccgctgcctccatcgccgacactagcgctccagctgcagccaaggccgctacgagagcgcaggaagccctcgaggagcggctgcctgggggcgcaaggctcagggcgcgcacctggtttagaagatcatgaccacatggatcatctaactaaatggtacatggggacaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggtagagggacaaagaaggaagagatgcgtaagagggatcagacattgatgttatcttttatgaggtgtgtgttcttgagatttgaagaaattagatggaatgattctttagtatatgatgccctggaaaatgaaaacatccaagtgctgtctctctgtttccccagcagtgctgtaattcaaataaatacctttctttctcctatagctttaataaaccgtttgaatgttacataaa

SEQ ID NO: 9067 - DNA, 7927 bp, Homo sapiens
  ENST00000455756
agctcggctgttctgcgcacgctgagcggagggaatgagcttgagatcatcttgggggggaagccggggactggagaggccggctctgccctgctgatccccgtggcccaacttttcggggggctagctagaccgagtctcactgctcgcagcgcagccaacaggggggtttagaagatcatgaccacatggatcatctaactaaatggtacatggggacaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggaggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaagatgccaagggcaccccttaatggaaacacgagatcagtagtgctatctcatgacaaccgacgaagaaaccgacgacaaatcttttggcagattttcttctagtggccttagaaaacatgggcttttaagaaacacggctgatatctttgagggctgacaaggcgtctcttcaaacagttccataccaagtgctttgctctagggaagcagtgcgtgtgaaacagcgtaacggagggtgaagagcatagttaataagcaactgtaaaaagttttatttgtttactttaattcttttcccagaagagtctttgattcaccaaacatgaatgtacattttctaacaaactcaaaatctgggaccaaaacatcaacttttttctttcttttttctttctttttgttttttctttcctgtaaagaccttgaaaagcagtaacttgggtccagtatttacggaggcgttgtgaatgtgtcccatgcataacacactactggatagtgagtgctgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatcaatactggagtagcaaaaaaaatattttctggaatactgttttgtaattccctcactggggtgcattgtagctggaaattctctttataaaaatcattcttgagctccagcctggctatctctttcaagaaacatggccactctttaggaatgctgttgcgtttgcattgccaactaaaatattaaaatatgcattggggcttcttcattcctttattttgagaacctgatgcacaaagagctcctttgttcttttcgagtcccaccactggaagagtggtccatagaccccatgaagacattgtcatgatttgagagactgttgttgaaaggattaacacaatcttaatacactgaaaattttaactgtgtcaagtcagcttagtggagatttagctatgccagtgagcagtgattttaactattcttggctgcttaaacagggcagctatgaactatgacaaatgtagatttttcaaagcaatacaaaatactaaaaaagaggaaccttaatgaatattaaccacacagtctttcttagccattccaaaaagaggcaaagcaattcttattttcttttttaaaataatgattaatatgattttgtgcacttcatactgtcactttttaaaactacagaaaagagatttagagtataacagaaacaagtgtgctttgatagtctcaaataggtagaattcatagttcaagacctgaatccactgtcatctctttcttcctcccattgcagctatcctcaggtaccaaatgttttgatttttaaataaggatagtaataaatggaggaggtgtcctataaatttaaagttcagttgacccagccttatacttaagatagccttatgaaaaatatgtgctgtgaggcagaagtatattttggcagagagaataataaataaaactttttcttttagctcaatatccttactttggtaagtatttttttttatttcacatctacttaacagaaaataaactgagaaatagaagtcagtccattggcataatttatcattcttcactttaaaaaattctaataaatattctgcttgagttttcttttctgctatttgttcttacttgcaactttaagtcaaacctcccaatacaaaacattaaaagctaacattaatgtactaaagtattaatttaaaagaaatcgaacctcccatgctagatttgaaaataacatcatcacagcaccctgatcccaaatattacaccgaggcttttaaaatgtaagtgaaatctagctaagtttcatggtttcattaaaagcaaatgtctgcctctatctgaaaaacaaatggaaatcttttgaggtgttaataccctttggatcctcatcaaaaggatggcattcacctgaggattcctatcttgacttcttaggtattaaaaacctttcttgatatgctctacattttaaaatttgttttataaaatccttatgttgattttcattttattctcaagtacaatacgtttcactctagaccagttgaagaacatgtttaaactttgttcatggtcaaattcattttctatttttttagtaacatatctcttaaaaagcacactaccttataaaaaacttcatcagaaattaaatttaatgcaagtaaattgccatctgatacttccacatgctatcataatcaactgtaataataaaaatgatttatccaattagaaaaggacaagatatatttttctctgtatttctataacttttgccactccattgaatacattgtatgttggacataagattattagtaatgcattcttgagatcttttattttggaatgatgctaactctgtctctttgccaattctaataccaggttccaagtaataactctacagtacaaagagaactgaatattcattctagggctataggatatgaacttcacaattcatttgggtacattctcattgaatttccttcaaaacaatctgttcctggtgcccagtgataattcagtcgggaccagcatgactaaaaggaaggggatatgctaaggctcagcaaagtgaccctaaatgagagatatgtcccaggatggaaagaagaagacgtggtttaaccaagttatactgactaatctaagcagtccactcatccttccattttgggaaaggagtgggggcagcctaagaagaacatatctggattgggaagaaccgtctttctgggctagggatggggaacagaaagggagtatggaaagaaaaattataagagatttgactgaagcaaggaaaaaaagcaaatccccaaacgtgctaatccttgaaagtaactatctttcccaaactactgctgttaccagcaagtgatcaggaagactaggagctatttctgactgtaaatgaattgtataatagctctgctgcagttctgtgacttccaagccaggaattaaatgctctttttaagaataacaaaaaacaaaagcatttcctatgctagtctcccagtaaaatgtacatgttttggagacttcaaaggtattatgtgagttcacatttagcaacagcttattaataaccctcaagctgtcagaatctctatagttaccatttacaattttatactgtgaaaaaatacagatcagtgaaagcataaagacaagtcagaattcactttgaagagggtctgaggcctgggagagtctctactgtctattgaagaatgaggcatgtataaaatagttggttgaatttcactgatcttcccaatgtgaacaaatatactatgtatattgtgtgtatttctagaaatcaatggcagctgctgatggtgttgtaattagaaatctatatagattatagatgttttagaaagatggtgccaatcctaaaagatttgtgtgggctaaaagtgcttgtacttacttttttctgcacttataactgatttggttttaaaattgtgtgcgtgtatctgttctttctctgttgtggcagcttgtactattaaaataatagagaatgttaaattattttgatgtgaactgcaaatgattttttttcataaagtttaacatttttatcagcattgttttgctttgtacttgtataaatatgttttattttagcacttcaaaatatacttgcctgtttctcagttgtctaaatcatgttgtacttggtgtttgtgaagccagttacttttcaaaaaaattaaaaaacctataatatga

SEQ ID NO: 9068 - DNA, 579 bp, Homo sapiens
  ENST00000443259
acggtgcgcgcacccactgacctgcgcccactgtctggcgctccctagtgagatgaacccggtacctcagatggaaatgcagaaatcacccgtattcggccatcttggctcctcccccgaagtgttatggaatacaaggtattacacagaagcagcaatttggaaagaccatcttgagagattcttcataaaaacagaaccccagtctataaggaaacatccatgtctgattagcatgaaggttatgaggagaacgtgatcacagccaaggtagtcttctcaaaaaggtagaactagatgacattgcaggcagtgagatgttatcatgtttgacccctggaactgtccaaaaatggaagaagctgcctcatcagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagattt

SEQ ID NO: 9069 - DNA, 595 bp, Homo sapiens
  ENST00000448328
agatggaaatgcagaaatcacccgtattcggccatcttggctcctcccccgaaacatccatgtctgattagcatgaaggttatgaggagaacgtgatcacagccaaggtagtcttctcaaaaagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgca

SEQ ID NO: 9070 - DNA, 3289 bp, Homo sapiens
  ENST00000467425
agtgctgggctgttggagagagcgagcagcaagccggtgagcgcgagcgcggcgcgccggccggctaacccgagagcgcgaggcgccccaggctggcaggcgccgcgggacccctcaccctctctggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacaactgtataccaccagtaagaaagagtgtacaaaagtctgttacttggtacactatcccaccaacagtatagcttttgactgctttcccaaagatttttttttttggctgtacagtggaacttggattacactttaaattaactttctctaggaatcaaagtaacctctgaggacctcagcttgcacaaagaggattgagataacatttccaaagcttgttcttcttgagctgacccaacacttaggaaaacatgacatggatcagcaactccattttctgtgagaagtgcaactgctactgaccatctgcactggca

SEQ ID NO: 9071 - DNA, 4127 bp, Homo sapiens
  ENST00000357716
agtgctgggctgttggagagagcgagcagcaagccggtgagcgcgagcgcggcgcgccggccggctaacccgagagcgcgaggcgccccaggctggcaggcgccgcgggacccctcaccctctctggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacagccctgctgcaaaaaagaagtatgtcagttataataacctggttatctaacctgttccattccatggaaccatggaggaggaagaccctcagttattttgtcacccaacctggcataggactctttggtcctacccgcttcccatcaccggaggagcttccccggccgggagaccagtgttagaggatccaagcgacctaaacagctgctttatgaaatatccttactttatctgggcttaataagtcactgacatcagcactgccaactcggctgcaattgtggaccttccctaccaaagggagtgttgaaactcaagtcccgccctggctctttagaatggaccactgagagccacaggaccgttttggggctgacctgtcttattacgtatgtacttctaggttgcaaggttttgaaattttctgtacagtttgtgaggacctttgcactttgccatctgatgtcgtacctcggttcactgtttgttttcgaatgccttgttttcatagagccctattctctcagacggtggaatatttggaaaaattttaaaacaattaaaattttaaagcaatcttggcagactaaaacaagtacatctgtacatgactgtataattacgattatagtaccactgcacatcatgtttttttttttaagacaaaaaagatgtttaaagaccaaaaactgtgctgagaaagtatgccccacctatctttggtatatgataggttacataaaaggaaggtattggctgaactgaatagaggtcttgatctttggaatgcatgccagtaatgtattttacagtacatgtttattatgttcaatatttgtatttgtgttctcttttgttatttttaattagggtatatgaatattttgcaataattttaataattattaagctgtttgaaggaaagaatatggatttttcatgtcttgaggttttgttcatgccccctttgactgatcagtgtgataaggactttaggaaaaaaagcatgtatgttttttactgtttgtaataagtactttcgttaatcttgctgcttatgtgccaatttagtggaaaaaaacaacccttgctgaaaaattccctctttccattctctttcaattctgtgatattgtccaagaatgtatcaataa

SEQ ID NO: 9072 - DNA, 4241 bp, Homo sapiens
  ENST00000486284
agtgctgggctgttggagagagcgagcagcaagccggtgagcgcgagcgcggcgcgccggccggctaacccgagagcgcgaggcgccccaggctggcaggcgccgcgggacccctcaccctctctggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacaactgtataccaccagtaagaaagagtgtacaaaagtctgttacttggtacactatcccaccaacagtatagcttttgactgctttcccaaaggccctgctgcaaaaaagaagtatgtcagttataataacctggttatctaacctgttccattccatggaaccatggaggaggaagaccctcagttattttgtcacccaacctggcataggactctttggtcctacccgcttcccatcaccggaggagcttccccggccgggagaccagtgttagaggatccaagcgacctaaacagctgctttatgaaatatccttactttatctgggcttaataagtcactgacatcagcactgccaactcggctgcaattgtggaccttccctaccaaagggagtgttgaaactcaagtcccgccctggctctttagaatggaccactgagagccacaggaccgttttggggctgacctgtcttattacgtatgtacttctaggttgcaaggttttgaaattttctgtacagtttgtgaggacctttgcactttgccatctgatgtcgtacctcggttcactgtttgttttcgaatgccttgttttcatagagccctattctctcagacggtggaatatttggaaaaattttaaaacaattaaaattttaaagcaatcttggcagactaaaacaagtacatctgtacatgactgtataattacgattatagtaccactgcacatcatgtttttttttttaagacaaaaaagatgtttaaagaccaaaaactgtgctgagaaagtatgccccacctatctttggtatatgataggttacataaaaggaaggtattggctgaactgaatagaggtcttgatctttggaatgcatgccagtaatgtattttacagtacatgtttattatgttcaatatttgtatttgtgttctcttttgttatttttaattagggtatatgaatattttgcaataattttaataattattaagctgtttgaaggaaagaatatggatttttcatgtcttgaggttttgttcatgccccctttgactgatcagtgtgataaggactttaggaaaaaaagcatgtatgttttttactgtttgtaataagtactttcgttaatcttgctgcttatgtgccaatttagtggaaaaaaacaacccttgctgaaaaattccctctttccattctctttcaattctgtgatattgtccaagaatgtatcaataaaatactttggttaactttttta

SEQ ID NO: 9073 - DNA, 3088 bp, Homo sapiens
  ENST00000440923
ggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacaatttttttttttggctgtacagtggaacttggattacactttaaattaactttctctaggaatcaaagtaacctctgaggacctcagcttgcacaaagaggattgagataacatttccaaagcttgttcttcttgagctgacccaacacttaggaaaacatgacatggatcagcaactccattttctgtgagaagtgcaactgctactgaccatctgcactggcatctagtcaagcgattg

SEQ ID NO: 9074 - DNA, 2901 bp, Homo sapiens
  ENST00000389336
ggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacagtgagaagtgcaactgctactgaccatctgcactggcatctagtcaagcgattg

SEQ ID NO: 9075 - DNA, 3020 bp, Homo sapiens
  ENST00000389335
ggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacataacctctgaggacctcagcttgcacaaagaggattgagataacatttccaaagcttgttcttcttgagctgacccaacacttaggaaaacatgacatggatcagcaactccattttctgtgagaagtgcaactgctactgaccatctgcactggcatctagtcaagcgattg

SEQ ID NO: 9076 - DNA, 826 bp, Homo sapiens
  ENST00000435689
actatctccctgacgcagaccccaagccaaatcctcggcttggaggacgattcccggagcgaggcatgaaggcgcccgttgggaggcagaggggtgcgtgaagcggggccccgtggtcctcctgctccggtgccggagggagacggagaaaaaatgggaggaaggcggatccggggccgctgagcggtgggttctgccgcagtgttctctcgcctcctgctccagcagcctctgccccatggctcctgagctgcactggggagatgcccttctatcctgtctcagtttcccaatcctaaacgtccttcaaaaatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaag

SEQ ID NO: 9077 - DNA, 546 bp, Homo sapiens
  ENST00000461677
agtattgcatatccgggattcagaatctcctcctcatctaccttccttggctcctttgacatctctgtggaaacattattgacactatgttttcttctcttaaacaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacagg

SEQ ID NO: 9078 - DNA, 4003 bp, Homo sapiens
  ENST00000463676
ggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacagtaagtaactctccgtttctttcatcttcccaccctgcatcaggaagctctagaagatgtggggtgtgcttgcctctctggagaaatactgtgatcgttcttgtcttatgggctgggttgccttggtgaatgccagcttctgctcttttgagtttgactcattcctgccaccattttctttttgttccttgttggaaagaagcttttggaggctctgcttcagaagtgtgaagcctcccccttcccttgcttcttgtcctctggtactgaatcctccaactgacaaatgcacctatcaggttgttcttttcttgcacccttcctgctaaggcaacaactttttgtcagggaaacttccatacttaatgaactgtatcggtgggaattaattaggattttggaagcgaaacttttttcctctagcatgtgaatgttgaaaaagttattttgtactaatcaggtcttctagaaacatataaaatattggaaaaagttgtcaaatccaggtacacagggccagacactaccatgataacggcatcatactgtggggaaaaacatatctaccataccactggagaagagttttattctatgcaagacaaaccttagggaagaaatcaaggaaaaaaaacattggatttaagatgctattatatggcatatctgcaaaactctaggagcctttagtcatgcatgcaaatgtccccaggtaaaatgggcatatagctatcactttgtaagtaacacaagaccagctcaaaggttaaatgcttagaattcccaattgctaactttactaacaatatggtggtaagagtaaatttcagatttaaaatactagttttaagatttgttttccaggaatattttggctagttgcatttagaatgaggcagattcaaatatttgtgatacttcctgttgtttaaggcagaagggatttcaggttatccattaagtcattcacgacatactgtatttcagttagaagctgatcttggtgtcaaatgcttaatgccaaatagaaggaagtctcaattttaagtactcttgaagaaatcctttttgctctgcaaataagagagatatctttaataaaaaccaagaagccaactgggtttgatcctgacaaacactacacaaagaactgtgattttggcctgtctctatttatgaatagttgagtgaatgtcgtgaaatactttgaaaatatgtagacaaagtaacaaggttaattaacaacattgtgggctccagtttgactttgtgacagaagtcctaggacaagtctaaaggaacatactgagaagggaggaacagaatgaatgatataggctctgttgtgtctccagagcaagtggccaattgagaggagggcaagtggatggtgacttgctgtggcattcagtgtgatgtaggaagaggctttgggttgagacatacctgggttcaaatgtaaaccactccatttaccagccatgtggcattaagaatcactgagcttttctaaaactcaacataattatgtataaaagagataataactatgtcataagtgtatcacaaaatactatattgagaaaatactatatcaactaaatgtcaacgtctttcccttcctgaagaggcaaaaagctttgcttagaaataagtttcagcataatttattaagatatagtagctaaaaagatgcagttaagtgtagattaaacaccacagggtagataaaactcaatcctcaaaagaagaatttatggctgggcgtggtggctcacgcctgtaatcccagcactttgggaggacgaggtgggcggatcacctgaggttaggagttggtgaccagcctgaccaacatggagaaaccccgtctctactaaaaatacaaaattagccgggcatggttgcgcgtgcctgtaatcccagctacttgggaggctgaggcaggagaatcgcttgaacccaggagggcagaggttgcagtgagctgagatcgtgccattgcactccagcctgggcaacaagagcaaaactccatct

SEQ ID NO: 9079 - DNA, 683 bp, Homo sapiens
  ENST00000445087
aaaatgaagatggtaaccaggcaacatggttcttctatagttattaaaaataaaacgtgaagcttctacaatgcacaataattttctgacaagtttgtctggctttctttctgtcattgcctggagaaatggggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaag

SEQ ID NO: 9080 - DNA, 1937 bp, Homo sapiens
  ENST00000458641
atcagttgttatcattattaggcagatgggagcaaaatggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaattaattaccaaggggccttgcactgagggcatcaacaagatatgtggcccaagacagctgcttggcttcccatccaagataaagtcagatgctctagaaatgtgtgcatgttgaggactgaagggaggagaaactttgcttcttatttatcacctgtcaggtctggagaagcacagatgccaagtgcatggaacacagaagctgctcagtgaatggcctttgattatgagataggagaattacaagatgatgttagaaggatgggatagagaccatttgtgcctgctacagaatgttggcatggaaagtccttccaggacatcgtagtacccttagtagtatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagcatcagtttgctaaggataacagcctccagctccatctatgttcctgcaaaagacatgactcatgcttttttatggctgtacagtattccatggtctcaggctttccctgaatcattgtaagataatggagacgcagcaatgactgttcttgttatcctccccgaccggactaaatgaagacggggcctctgtcctatttattttcctgagcatctaatggtgcctggacacacactgtcattgtttgaaaaatgagtacatgttcactctaaagttacaag

SEQ ID NO: 9081 - DNA, 160 bp, Homo sapiens
  ENST00000471242
gtgagaagtgcaactgctactgaccatctgcactggcatctagtcaagcgattgtctgaggcaagattttggagattcccatctgatattcttctatttggtctcttgtacccattgtcatcctgtaccacacataataaagtttaagaatgtcaagcaa

SEQ ID NO: 9082 - DNA, 2034 bp, Homo sapiens
  ENST00000402647
ggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacaactgtataccaccagtaagaaagagtgtacaaaagtctgttacttggtacactatcccaccaacagtatag

SEQ ID NO: 9083 - DNA, 4057 bp, Homo sapiens
  ENST00000339582
gatttttaaaaatcagaactattgacatttctggtctcctcgtcgcttcaggctgaagagcggagggggatccgcgggccgagggtccccctccctgcccgcgccagggccgctgggtgacaccgaaatccagaggctcccgcccctcgggggttcctcctcccgcttcccgaggtgactggttggcgcgaagcgattggcgatcccgggcgcgatcctggccgcggctccccgcgccgcgccgggtgaatggccgcgggcggaggatcgggaggcgccgggcgcagaccaatcgcggccgccggtgggagtatttgttattcacatggaagagacttggcgcctgctaggccagctcagccccctcagcccagagatcagccacaagtgcggccgctgtgctcgcctcacgcggcggcggcggcggcggcggcggcgctgacatggagctgcgggcccccggcgggcttcctcaccgcgccctctgcggggagcagggaataattctgctacaaggctgatttcaaggacatgaattgttgacctcatcccaacatcagaacctcagatgttctaatttttgcaccattccaggcaagttgatcttataaggaaataaaattgaaccttaggggtctgatggaaattcactgtgacattcaaatcaagaaaacttgctaatgcccacagagccttttccccatgggccctgatggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaaggaatgttttgcaaatgtt

SEQ ID NO: 9084 - DNA, 3850 bp, Homo sapiens
  ENST00000358373
acattacagtaaagaggttcagaaaagagggagactttacccggaactcccaaggcttggagatgtgatcccccaaaagtttagtcggcgaatgggagactgaagggtgacgggaagggggcaggcgcgctcggcgctctgactgggcgtgcggcggcaggattttaaagcgctctgcctcggatcgtctgccctgggtgacctcccggacctgccctggtggaatccggacttgccccgccgagatgacgaggaataattctgctacaaggctgatttcaaggacatgaattgttgacctcatcccaacatcagaacctcagatgttctaatttttgcaccattccaggcaagttgatcttataaggaaataaaattgaaccttaggggtctgatggaaattcactgtgacattcaaatcaagaaaacttgctaatgcccacagagccttttccccatgggccctgatggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacagtaagtcatctgtagagtttccgatggtcaagagcgggagcacttcctaatagatcttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaagg

SEQ ID NO: 9085 - DNA, 910 bp, Homo sapiens
  ENST00000489939
gaccaagaagagcgaagacagtctggagaaaaaaattaagttggaagacatatactaccaagtattgagattcttaacctctagcttgtagaaagaaaaaccttccagaaagagctctctctatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttattt

SEQ ID NO: 9086 - DNA, 3240 bp, Homo sapiens
  ENST00000341617
ccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggttgccgaagagggatccagatgtctctaccctggccaactctttttactccttcattttccagtagttgggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccc

SEQ ID NO: 9087 - DNA, 831 bp, Homo sapiens
  ENST00000495315
attcttaacctctagcttgtagaaagaaaaaccttccagaaagagctctctctatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacagtaagtcatctgtagagtttccgatggtcaagagcgggagcacttcctaatagatcttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagcc

SEQ ID NO: 9088 - DNA, 3650 bp, Homo sapiens
  ENST00000472701
gatcccgggcgcgatcctggccgcggctccccgcgccgcgccgggtgaatggccgcgggcggaggatcgggaggcgccgggcgcagaccaatcgcggccgccggtgggagtatttgttattcacatggaagagacttggcgcctgctaggccagctcagccccctcagcccagagatcagccacaagtgcggccgctgtgctcgcctcacgcggcggcggcggcggcggcggcggcgctgacatggagctgcgggcccccggcgggcttcctcaccgcgccctctgcggggagcagggaataattctgctacaaggctgatttcaaggacatgaattgttgacctcatcccaacatcagaacctcagatgttctaatttttgcaccattccaggcaagttgatcttataaggaaataaaattgaaccttaggggtctgatggaaattcactgtgacattcaaatcaagaaaacttgctaatgcccacagagccttttccccatgggccctgatggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacagtaagtcatctgtagagtttccgatggtcaagagcgggagcacttcctaatagattccacccaggaaaaagcacatgataacaatacacagaaatctgtgctcaaccagtagaatttaactgatctattgaagcccatcttggtatctatgaaagagtggcaaataatttgaagatttgtatggtaaaataccaggaagctgaatatggtaaacattacaacctttaccttactaggttctacagatgaatcaaaaaagaaagaaaagcaaagcttcctctaccaagacaacatatatcagttacagcaatcattcaatctgaaacagggaaatggcacaatctgaagagatgtggtatatgatc

SEQ ID NO: 9089 - DNA, 1878 bp, Homo sapiens
  ENST00000480995
agacaacactagatggggtggtcagggaaggtctgttgagctgaggctgaaggatgagaaaggccaggaaggacttacttgggaaaatgtttgtggtgatatgtatgagtgctgcaggtgaaacaaaaaggaagccagtgtagttggatcagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattgaaaatgtatgaaaggcctggtcttgttggacagattgggctaattgatttaattggacaactgttcacacctgctgtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggttgccgaagagggatccagatgtctctaccctggccaactctttttactccttcattttccagtagttgggcagtgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttc

SEQ ID NO: 9090 - DNA, 843 bp, Homo sapiens
  ENST00000448250
catttatgaaatcagctttttggtctttgcaaatggagtgggttttccccctatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaat

SEQ ID NO: 9091 - DNA, 1247 bp, Homo sapiens
  ENST00000457830
gcccaaactgtgaagcctggtgtcagagagtgtctgcgcacccaagatagcgggggaataattctgctacaaggctgatttcaaggacatgaattgttgacctcatcccaacatcagaacctcagatgttctaatttttgcaccattccaggcaagttgatcttataaggaaataaaattgaaccttaggggtctgatggaaattcactgtgacattcaaatcaagaaaacttgctaatgcccacagagccttttccccatgggccctgatggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagc

SEQ ID NO: 9092 - DNA, 429 bp, Homo sapiens
  ENST00000465844
tttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggttatccatccctgtttgggattcagggctgccttcatgaatgttttgctatactatgtcaagttgtttaccaatttctgcttctaatgcagctgtcagatgctcaaactgtctattagtcgaagaggctctctactgaccacctttctcaagtttcttcttcttacatacaatgtttttgacaagactaagcatatcaaaccatcttttaacaattgtaaagcctaatattggccagcatacaattcaattcattaaacattgtagcactg

SEQ ID NO: 9093 - DNA, 365 bp, Homo sapiens
  ENST00000423518
gacatggcagccttcagtagcagtgactcctgcactgacaccaccagtatgagtgggtaagttagtgatgggacagaaacacttctcaagatcttcaggcttggccaaggattatcagcccatgtgaatatggaatgaaagaaggcaaagagcggtatagtttgttctcttccttttctgcaagaagtctggaagtgtgttggctggttgtgtccctctgcaaacaaaggcagcgaggatccagctccttcccactgttctgtgcttctacccttagcatgtggtctttcttatcagtcagccctcattgtctcctggtagcaggtccagggatcacaagtaaatggtgacatctatagaaaaac

SEQ ID NO: 9094 - DNA, 477 bp, Homo sapiens
  ENST00000465800
atgtgatctttgcctcaatggaggcatcatttagaggcattgcccccaaaacactgtgcctgagagagagcatcctgcagttcatgtaatgaaaagacctggcatgagacagtggagcaggacagctatggaccccaaactcaaagaggtggaaagcataccacagacatctttcattagcactgtagctgcactgtctagaagataatctgagagtgcttgttgaatgaaggaatagatggacatggcagccttcagtagcagtgactcctgcactgacaccaccagtatgagtgggtaagttagtgatgggacagaaacacttctcaagatcttcaggcttggccaaggtactcaaatgcatagctgttggagatagcaagaggactacatttttacttattttcttaaaatattccaactcctattctgttttgtgtttaaaaattctagtgtttgcaaatatcttgaaggaac

SEQ ID NO: 9095 - DNA, 647 bp, Homo sapiens
  ENST00000473254
gttgagctgaggctgaaggatgagaaaggccaggaaggacttacttgggaaaatgtttgtggtgatatgtatgagtgctgcaggtgaaacaaaaaggaagccagtgtagttggatcagcaccaaataactccccaggcacatgactatctgctaagaactgcgttcgagataattcagcttgaacctgtgcctcctactcttgcaccatatctcaaccttgggacccacttctgcctgcacggaagacttaaagttcacttgcaatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattgaaaatgtatgaaaggcctggtcttgttggacagattgggctaattgatttaattggacaactgttcacacctgctaggtggaaagcataccacagacatctttcattagcactgtagctgcactgtctagaagataatctgagagtgcttgttgaatgaaggaata

SEQ ID NO: 9096 - DNA, 551 bp, Homo sapiens
  ENST00000412160
aagaatacactagagtctgggctactaccgcgattgaatacaaatcctgccaactgacagaactggaaaacagggttggtggtggagatacaagaaaaatcatgaacgggagaaaagcattcctatggtagcttgtattttgcttgaaagaaaaatagagaaaaagagccaccagcaggaataattctgctacaaggctgatttcaaggacatgaattgttgacctcatcccaacatcagaacctcagatgttctaatttttgcaccattccaggcaagttgatcttataaggaaataaaattgaaccttaggggtctgatggaaattcactgtgacattcaaatcaagaaaacttgctaatgcccacagagccttttccccatgggccctgatggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagtt

SEQ ID NO: 9097 - DNA, 1251 bp, Homo sapiens
  ENST00000444921
aattttttatacccacaggtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctga

SEQ ID NO: 9098 - DNA, 2618 bp, Homo sapiens
  ENST00000491796
acagagcctgggctcactgaccagcccaggaggaaccagcctctgccttaccaggccatcaatccctgaagccaggggatctgccctgccagacacgggcatgtgtgtgtgtgtttcaggcttatcatccttgcattgctgggggtttcgcaacacggggaacgttgctggtctggctgaggtttctgtcgtgccacccctcctgccctgcttatggagctactgtatgtgtcagggccgtttgcatcctgttactagtcagtctatcttaatgcactttaggaaactcttccctttccttgcacgtgctttgcgtatactagttccccataaagaatgtcactgcctgaaacagaacattctgtgaaatgcagggctgttggattcacatgttaaattgtttcatctcaatcacgagggttgtgtaggatccagggaagatttatcccggggggtcaagagatatcgatgccctcccagaaggagttgccagcccactgagcagggtggttctgccctcttgcctggcactggatctcaagtatttaagaagaaaagaatggaatacaaagaagttagaagcgctttggggcagattttccagcaagactgggtttgtctgcccctagggccactacactgtagtgtgcattgcaaatcatggtggagaaggtaccatttgatttaacatatcacttttccacctttacctaactacctttgtagtctgataacttgtgccagttagtattatttgctgcagtaattgactggccccctcagctcagtaactcccaaggctactgaactacagggttcagaaagtagaagggagccatgcagtccttccaccgagcgctgttccctcaatttatgaccccagaagggttaagagaaggcccaagtccctctgtttccagtggagcagaggttcttagcagtgagttttagtgttgaacaaaaatcaaagctagagcctactggggttgaggaatgtgttggtttctttctttctcggtcattccctgtttcacacagctctgataagttcaccttgtaggactaggtcacacttaggtgatgaaaaattttcatcctgtgttatgttttctcaatgactcagagaagggaaacccaggctgattcttcttccttctaacccatctcctgaaaactgctcagagcctaactattgctctgtttcatttcagggccaagattaacacccctcctgcaggaggaagacagccaccagcggctgctcatggggctgatggtgtctgagctaaaagaccattttttgagacacctacagggtgtagaaaagaagaaaattgaacagatggttctggactacatttcaaaactgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatgaaaaagaaaacgcaattggatctgctgctgccattttaatcttgctcattaaccttactcctttgagaattctttaacaatatttaaaattggtaacaaaaatagtttagccataattgtttagccatgtgagtttcaggttggtacacgttcagacagaactgctgtatcacattccaattttgaatagccagtgagcaatcaagtgtagagaaatgataaatggcctaagaaggcatacagtggcataaacgatgctcttcctagtagcttaataggccacaagctagtttctgttgcactctgaaataaaatatgctttaaaaatgtagggaacagtgcttagaaaagcaaaaactaggtgtgtcattgaaataataggcataaaaattaaatgttacataagaacactatttggaaagagggtccttttaaaaactgaatttgtactaaatcagatttgccatgtccagtacagaataatttgtacttagtatttgcagcagggtttgtctttgtgaattcagatgaaacatatttatttttttttatttataaaaggttgatttaggaatattttgtcagtcattaaaaaacctgaaaacata

SEQ ID NO: 9099 - DNA, 2975 bp, Homo sapiens
  ENST00000449779
tacttacctggtcatttcttccacctacttaatgttcaacatccagacctgatctgccacaatctctttctgacaggaaataatgaaatgattgatatgctacctcattgccctttacagtcattgtcagggtccctggtattggattgttgttctggaaagctctatagagcactgctcagccagtcgtctttattacagcttctgcagaacacttgcttagactgtgagaagatggctgcgttgcactgcgcgctctactgcggtcaaggtgcgcagttcctggaagcccagattattcagtggatttctgagaatgtctctgcctgccattcatttgacctcattcaggaatttataattgcttcttcatactggagtgtatattcagagacaagtaacatggacaaactattgccacattcctcagtgctcacttggaatacagaaattcctggaataactcttgtgacagaagacattgcattgcctcttatgaaggtgctcagctttaagggctactgggaaaaactgaactccaacctagaatatgttaagtacgccaagccacacttccactataacaacagtgtggtcaggagagagtggcacaacctgatctctgaagaggtatgagtgggtcagtgagaacaaagccagcagcgaggcatagtggactggatccaggtgatgcctttaaatcataaggctggcttccatgtgcagcactcttcccaattgccagggacttgatcattgtcattactgatctcaatgggcagagatgcttctatgatctctgttctcctagggaggaaactgaaaagcagaaagtttaaggggacacacagcacattcatagtagaagtatgattaatatccatgtctcagatgtgttctcaggttacttatgtagttaaaaattgatattaaaaaatctaggtgttcccaacttagtggtcattaggggttggggtagttggagggagaatagtggacgtgactcactgtccaggggtgacccagggaaatctttgggggtgatcgaagacttctatgtgttgattgtggtggtacattgtgggacatgaatctaaacatgataaaatgacatagaatgacacacacacattgtgccaatgtcaatttttgattttgatattgtgctctagttaggtaagatataagcactgaggagactgggtggagggtacattgcatctctctctagtatcgctgcatgtagattagtgttgttgtgtgtagtatatagttgactcgcagtttcctgtgaatctgtaattgtttcagaataaaatatttcttaaaactttaaaaaaaatctaggtgttctgattacctggaaagtatatttcttctctctgatgctcttaactgtattgcattatatccttgacgtgaaaagtcaccgataaaacctttaccttccacatttctgacgtgttctcactcctagaaaacaggaaaaagaaggtctgcggcatacgtgaggaatattcttgataatgcagtaaaggtgatttctaacctagaagcaagaaatttggggccaagattaacacccctcctgcaggaggaagacagccaccagcggctgctcatggggctgatggtgtctgagctaaaagaccattttttgagacacctacagggtgtagaaaagaagaaaattgaacagatggttctggactacatttcaaaactgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatgaaaaagaaaacgcaattggatctgctgctgccattttaatcttgctcattaaccttactcctttgagaattctttaacaatatttaaaattggtaacaaaaatagtttagccataattgtttagccatgtgagtttcaggttggtacacgttcagacagaactgctgtatcacattccaattttgaatagccagtgagcaatcaagtgtagagaaatgataaatggcctaagaaggcatacagtggcataaacgatgctcttcctagtagcttaataggccacaagctagtttctgttgcactctgaaataaaatatgctttaaaaatgtagggaacagtgcttagaaaagcaaaaactaggtgtgtcattgaaataataggcataaaaattaaatgttacataagaacactatttggaaagagggtccttttaaaaactgaatttgtactaaatcagatttgccatgtccagtacagaataatttgtacttagtatttgcagcagggtttgtctttgtgaattcagatgaaacatatttatttttttttatttataaaaggttgatttaggaatattttgtcagtcattaaaaaacctgaaaacata

SEQ ID NO: 9100 - DNA, 3251 bp, Homo sapiens
  ENST00000257626
cgagggcgaggcggccacgcggggccgggaatgcccgcggtgcggggccccagagccgcccggtggtcgtgtccgggcgatggctcttcgcctggtcgccgacttcgacctcgggaaggacgtgctcccgtggttgcgggcgcagcgggcagtgtcggaggccagcggggccggaagcggcggcgcagatgttttagaaaacgattatgagagcttacatgtattaaatgttgaaagaaatggaaatattatttatacctataaggatgataagggaaatgtcgtctttggattatatgattgtcaaaccagacaaaatgagcttctatatacctttgagaaagacttgcaagttttcagttgctctgtcaacagtgaaaggactttgcttgctgcaagtttagttcagtctactaaagaaggaaaaaggaacgaacttcaaccaggatcaaagtgcttgactttgttggttgaaatccaccctgttaacaatgtgaaggttctaaaggctgtggatagctatatttgggttcagtttctctacccacatattgaaagtcatcctcttccagagaaccatctgttactgatttcagaagagaaatatattgaacaatttcgtatccatgtcgcccaagaagatggaaatagagtggtgattaaaaattctggccatctcccaagagacagaatagctgaggatttcgtttgggctcagtgggatatgtcagaacagagattatattacattgacctgaagaaatcaaggagtatcttaaaatgtatccagttttatgctgatgagagctataacttaatgtttgaagtacccttggacatatcattaagcaactcaggatttaaacttgtcaactttggatgtgattatcatcaataccgagataaattttccaaacacctgactctgtgtgtttttaccaaccatacaggaagtttgtgtgtatgttacagcccgaagtgtgcctcttggggacaaatcacatattcagtgttttacattcataaaggacacagcaagaccttcaccacttctcttgagaatgttgggtcacacatgacaaagggcattacttttctcaaccttgactattatgtggctgtttacttacctggtcatttcttccacctacttaatgttcaacatccagacctgatctgccacaatctctttctgacaggaaataatgaaatgattgatatgctacctcattgccctttacagtcattgtcagggtccctggtattggattgttgttctggaaagctctatagagcactgctcagccagtcgtctttattacagcttctgcagaacacttgcttagactgtgagaagatggctgcgttgcactgcgcgctctactgcggtcaaggtgcgcagttcctggaagcccagattattcagtggatttctgagaatgtctctgcctgccattcatttgacctcattcaggaatttataattgcttcttcatactggagtgtatattcagagacaagtaacatggacaaactattgccacattcctcagtgctcacttggaatacagaaattcctggaataactcttgtgacagaagacattgcattgcctcttatgaaggtgctcagctttaagggctactgggaaaaactgaactccaacctagaatatgttaagtacgccaagccacacttccactataacaacagtgtggtcaggagagagtggcacaacctgatctctgaagagaaaacaggaaaaagaaggtctgcggcatacgtgaggaatattcttgataatgcagtaaaggtgatttctaacctagaagcaagaaatttggggccaagattaacacccctcctgcaggaggaagacagccaccagcggctgctcatggggctgatggtgtctgagctaaaagaccattttttgagacacctacagggtgtagaaaagaagaaaattgaacagatggttctggactacatttcaaaactgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatgaaaaagaaaacgcaattggatctgctgctgccattttaatcttgctcattaaccttactcctttgagaattctttaacaatatttaaaattggtaacaaaaatagtttagccataattgtttagccatgtgagtttcaggttggtacacgttcagacagaactgctgtatcacattccaattttgaatagccagtgagcaatcaagtgtagagaaatgataaatggcctaagaaggcatacagtggcataaacgatgctcttcctagtagcttaataggccacaagctagtttctgttgcactctgaaataaaatatgctttaaaaatgtagggaacagtgcttagaaaagcaaaaactaggtgtgtcattgaaataataggcataaaaattaaatgttacataagaacactatttggaaagagggtccttttaaaaactgaatttgtactaaatcagatttgccatgtccagtacagaataatttgtacttagtatttgcagcagggtttgtctttgtgaattcagatgaaacatatttatttttttttatttataaaaggttgatttaggaatattttgtcagtcattaaaaaacctgaaaacata

SEQ ID NO: 9101 - DNA, 3458 bp, Homo sapiens
  ENST00000482866
tttgtcaggtaccttcccaagagtaggctatgattcttctgtcagtcattcccacattcaatgagttgcaaagcctgtacatgttaccatgcctctctgattcagtgcctccattacctcttatccacgttcaggcaatagcttctctacaggtcttcataccttctgtagcaaattattactccaactcattctttgcctgttgccatattaatatcccaatggtaaatcttctgttctgcttaaaaactttcattacctcctcaaagtctctcaaattaataaatctctatcattcagcattcaacctctgtcacctgcactcataagcacagaactggtcacatttttaaaaatgtctattttttgtaattgattgtctgcctcccccagcagactgcaaggtgtatgggagcagcagttgtgcctgttttgctcatttttatactcttagccccttgccaggtgtgtggaagggatgtgctgaataaattagcttttccaaccttacctcttaatctttctctcctctaatatgattccaacccagctggatcatttactattttctgaatatgccctgtgctttctcatcttcggacctctgttcatgttctattaacacagctgccagttattaacagtgacattatggttgaaagcctaccctacaatcacacagttgatgcaaatttcaacttacacattattatttctgtgatcctgggcaagttgcctagctcctgtgaatcttggcttttggtttttccatttatgaaatgggaatctagtaattcccaccccatacttttgtatgaggatcagatgagccaggacacaggttgaaagccttggtacatgtccagtatgggtcgctattgttatattgcatgctaggctcttcacagacctggctctagttctcaaagcagccctgtgggaaaggtactggtggttccaatttagagatgaagaaatggaggctcagaaaggcttagttgcctgcagctggtgagtaatacagctggattctggcctagggctgctcatgccaaacctggctttttctactgtccgcactcatttccactgataggaattgcatctgtcctttgaagctccccgcaaatgccatcacttccaagagagctgttttgattctctcctggtctgataccttctcccatgcatgatgtttttatctgttgtcagtagtagtatacttagagatctgggtttctgtgggtagctctacccgtgagacaggcttgagaatgcctgcctctcaattgaattcctataaatttactatctggccatattgtcttaattctttcttttctatactttagtccaagtagactctaaaagcctttctctagggcatacccagagataagccatataaactattgccttctggtccaaatttgtttcccttcagcaaaatggtcctcatcccaacaaccttttagtctggacatacgaaatctgaaatgcttctgtactcttttgctatcttactgtagaatcacaaacatatcaaaccgtaaaaccattgagcaggcccttgctctgtttctgtgcaggaagagacccaaggagcaaggaatgtatacttaccggaaacttactatagacccagcgtgatatttagttacgaataatacagagaaggaaacttggaccttgttttcaagaaattcagttggttccaggcaccaagcactgaactaagtgctttattaacatgatctaatccattccccgggggctgctggagatgttggctgactgtgtttaccctccagatctctcatcctaggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacaggtgagtttctctgaaagcacagccaactaaatgtttttaggatcctgtttgcccgtgacaacatatctgtatggacagcaattacagttcttatcactttattttaaaattgtgcttattgtggagaatcagcttacaccagaagtggtttcccttttagcctcggaattctatgattaacaagtcatcgttcagtgtagaatttctgcctctgaactacttcattgaaattctgacagatatagagtcctccaatcaaggtaatttactcccctgttctcagggtcttaccacttttcccttgacacatcagtccttccctattcacttctttgtcttctttccaaaatccttttaacatacaagtagacccttatagcaattggtttacattagcagtaccaaatttactacctagagtaaattaccaaataatcacctctgaagttttaaaagagtcaagaggtttaaagcccatttggttgatgcaaatgttcttggtgctgaagtttaaatttaagaacacattcttaaaaaattcattttactaaaatacaattatgattttaatgagctgtgagcacaaagttataaatgtttcacggacccatggtaaccctttttccctgccctctccccatttttttccagccctgtatccttttgaaggacatgacaatgtggatgcagaatttgtagaggaagcagctctgaaacacaccgcgatgcttttaggcttatgaaaaagaaaacgcaattggatctgctgctgccattttaatcttgctcattaaccttactcctttgagaattctttaacaatatttaaaattggtaacaaaaatagtttagccataattgtttagccatgtgagtttcaggttggtacacgttcagacagaactgctgtatcacattccaattttgaatagccagtgagcaatcaagtgtagagaaatgataaatggcctaagaaggcatacagtggcataaacgatgctcttcctagtagcttaataggccacaagctagtttctgttgcactctgaaataaaatatgctttaaaaatgtagggaacagtgcttagaaaagcaaaaactaggtgtgtcattgaaataataggcataaaaattaaatgttacataagaacactatttggaaagagggtccttttaaaaactgaatttgtactaaatcagatttgccatgtccagtacagaataatttgtacttagtatttgcagcagggtttgtctttgtgaattcagatgaaacatatttatttttttttatttataaaaggttgatttaggaatattttgtcagtcattaaaaaacctgaaaacat

SEQ ID NO: 9102 - DNA, 825 bp, Homo sapiens
  ENST00000474686
cttctgtactcttttgctatcttactgtagaatcacaaacatatcaaaccgtaaaaccattgagcaggcccttgctctgtttctgtgcaggaagagacccaaggagcaaggaatgtatacttaccggaaacttactatagacccagcgtgatatttagttacgaataatacagagaaggaaacttggaccttgttttcaagaaattcagttggttccaggcaccaagcactgaactaagtgctttattaacatgatctaatccattccccgggggctgctggagatgttggctgactgtgtttaccctccagatctctcatcctaggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatgaaaaagaaaacgcaattggatctg

SEQ ID NO: 9103 - DNA, 866 bp, Homo sapiens
  ENST00000440473
attccatcaaacgtctgcaggatttgtcttgtctttttttttttttttttttcttcttaaatacaaagaagacccaaagggtggataagtgtacgttcattataaataaatggaaagggaaagaaaagatgagtgaggtgctcagctttaagggctactgggaaaaactgaactccaacctagaatatgttaagtacgccaagccacacttccactataacaacagtgtggtcaggagagagtggcacaacctgatctctgaagaggtatgagtgggtcagtgagaacaaagccagcagcgaggcatagtggactggatccagggccaagattaacacccctcctgcaggaggaagacagccaccagcggctgctcatggggctgatggtgtctgagctaaaagaccattttttgagacacctacagggtgtagaaaagaagaaaattgaacagatggttctggactacatttcaaaactgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatc

SEQ ID NO: 9104 - DNA, 564 bp, Homo sapiens
  ENST00000415112
gtgctcagctttaagggctactgggaaaaactgaactccaacctagaatatgttaagtacgccaagccacacttccactataacaacagtgtggtcaggagagagtggcacaacctgatctctgaagagaaaacaggaaaaagaaggtctgcggcatacgtgaggaatattcttgataatgcagtaaaggtgatttctaacctagaagcaagaaatttggggccaagattaacacccctcctgcaggaggaagacagccaccagcggctgctcatggggctgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatg

SEQ ID NO: 9105 - DNA, 543 bp, Homo sapiens
  ENST00000426477
accttttaatatcttgctgttagagtggccgcacggctcttcccatgtctgtctaggcaccaggacctccggggacagctgctgaatgtgcttttgcgatgggagtccctgggtgatggccttgcggttctccttatttcctgtcatacagagctgccctctggctgtgcccacaggatgcattttggcatttcccttggcttggtgctgcttgctttctagctgtctgatcctaccgggtcttgccttgtttgtgcctctcatttgggttaaaaattgggcacacaggtcctagaggcataaagatgaggagcttccagggccaagattaacacccctcctgcaggaggaagacagccaccagcggctgctcatggggctgatggtgtctgagctaaaagaccattttttgagacacctacagggtgtagaaaagaagaaaattgaacagatggttctggactacatttcaaaactgctggatctcatttgccacatcgtagaaaccaattggaggaaacataatcttcattcctgggttct

SEQ ID NO: 9106 - DNA, 562 bp, Homo sapiens
  ENST00000489920
tctcaagggaggaaatgactcagtgtgtttaatacaggtttccctgctaagcctcaatctggggaagtcctgttggttttgggaagtgagcagcagttctctatgtggtttaaaaaaacaacgacaaaaaaaaaaaaaaaaaaaagagacagaaaatgaagtgggtaaagaagattctttaagtctattttagaatccctattgggtctagaatgccatcttctgtacaaagtattcactcagaaatgtggaccctgagagctcgggaaataaggcttgtgtaatactcactgggtggtttgggccactgggcctgcctctgaaggccactgatgtttttgtctcctacaggtgctcagctttaagggctactgggaaaaactgaactccaacctagaatatgttaagtacgccaagccacacttccactataacaacagtgtggtcaggagagagtggcacaacctgatctctgaagagaaaacaggaaaaagaaggtctgcggcatacgtgaggaatattcttgataatgcagtaaaggtgatttctaacctagaagcaa

SEQ ID NO: 9107 - DNA, 2277 bp, Homo sapiens
  ENST00000334003
atgttttagaaaacgattatgagagcttacatgtattaaatgttgaaagaaatggaaatattatttatacctataaggatgataagggaaatgtcgtctttggattatatgattgtcaaaccagacaaaatgagcttctatatacctttgagaaagacttgcaagttttcagttgctctgtcaacagtgaaaggactttgcttgctgcaagtttagttcagtctactaaagaaggaaaaaggaacgaacttcaaccaggatcaaagtgcttgactttgttggttgaaatccaccctgttaacaatgtgaaggttctaaaggctgtggatagctatatttgggttcagtttctctacccacatattgaaagtcatcctcttccagagaaccatctgttactgatttcagaagagaaatatattgaacaatttcgtatccatgtcgcccaagaagatggaaatagagtggtgattaaaaattctggccatctcccaagagacagaatagctgaggatttcgtttgggctcagtgggatatgtcagaacagagattatattacattgacctgaagaaatcaaggagtatcttaaaatgtatccagttttatgctgatgagagctataacttaatgtttgaagtacccttggacatatcattaagcaactcaggatttaaacttgtcaactttggatgtgattatcatcaataccgagataaattttccaaacacctgactctgtgtgtttttaccaaccatacaggaagtttgtgtgtatgttacagcccgaagtgtgcctcttggggacaaatcacatattcagtgttttacattcataaaggacacagcaagaccttcaccacttctcttgagaatgttgggtcacacatgacaaagggcattacttttctcaaccttgactattatgtggctgtttacttacctggtcatttcttccacctacttaatgttcaacatccagacctgatctgccacaatctctttctgacaggaaataatgaaatgattgatatgctacctcattgccctttacagtcattgtcagggtccctggtattggattgttgttctggaaagctctatagagcactgctcagccagtcgtctttattacagcttctgcagaacacttgcttagactgtgagaagatggctgcgttgcactgcgcgctctactgcggtcaaggtgcgcagttcctggaagcccagattattcagtggatttctgagaatgtctctgcctgccattcatttgacctcattcaggaatttataattgcttcttcatactggagtgtatattcagagacaagtaacatggacaaactattgccacattcctcagtgctcacttggaatacagaaattcctggaataactcttgtgacagaagacattgcattgcctcttatgaaggtgctcagctttaagggctactgggaaaaactgaactccaacctagaatatgttaagtacgccaagccacacttccactataacaacagtgtggtcaggagagagtggcacaacctgatctctgaagaggtatgagtgggtcagtgagaacaaagccagcagcgaggcatagtggactggatccaggtgatgcctttaaatcataaggctggcttccatgtgcagcactcttcccaattgccagggacttgatcattgtcattactgatctcaatgggcagagatgcttctatgatctctgttctcctagggaggaaactgaaaagcagaaagtttaaggggacacacagcacattcatagtagaagtatgattaatatccatgtctcagatgtgttctcaggttacttatgtagttaaaaattgatattaaaaaatctaggtgttcccaacttagtggtcattaggggttggggtagttggagggagaatagtggacgtgactcactgtccaggggtgacccagggaaatctttgggggtgatcgaagacttctatgtgttgattgtggtggtacattgtgggacatgaatctaaacatgataaaatgacatagaatgacacacacacattgtgccaatgtcaatttttgattttgatattgtgctctagttaggtaagatataagcactgaggagactgggtggagggtacattgcatctctctctagtatcgctgcatgtagattagtgttgttgtgtgtagtatatagttgactcgcagtttcctgtgaatctgtaattgtttcagaataaaatatttcttaaaactttaaaaaaaa

SEQ ID NO: 9108 - DNA, 372 bp, Homo sapiens
  ENST00000434084
gactgtgagaagatggctgcgttgcactgcgcgctctactgcggtcaaggtgcgcagttcctggaagcccagtggaggcagagagcagatttaaataccaacagagttctgtctgactttttaaagattattcagtggatttctgagaatgtctctgcctgccattcatttgacctcattcaggaatttataattgcttcttcatactggagtgtatattcagagacaagtaacatggacaaactattgccacattcctcagtgctcacttggaatacaattgtgcagggtggagcagctattgtggacacgcacagggtgacatcaggaagtccaagaagagcgatataaagaaacctgtggttataacct

SEQ ID NO: 9109 - DNA, 600 bp, Homo sapiens
  ENST00000430584
gcatcccacctcccggggggttcatcggcagcgcaggggctttgccaagacaggagtgctcctggaagcttcacgttttgagaaagaatccgtgaccaccaagcaaaccaccctatacctaacggtggaacagtttgtccccacatttgcgagacgtgtttatgtgtctgttgaaccgtgtccgtggctcaggggacatgggcctcggcggtgaggcgcaagagggcaggggccgcctccaggctgcgcgcggcggggcgagagcccccagccgcccccgagctccgcacctgtgcaggctggggctgcgcgcgagatgctcggctcccggccctgccactccgggctttttgatgatttgatgttttagaaaacgattatgagagcttacatgtattaaatgttgaaagaaatggaaatattatttatacctataaggatgataagggaaatgtcgtctttggattatatgattgtcaaaccagacaaaatgagcttctatatacctttgagaaagacttgcaagttttcagttgctctgtcaacagtgaaaggactttgcttgctgcaagtttagttcagtctactaaagaaggaaaa

SEQ ID NO: 9110 - DNA, 737 bp, Homo sapiens
  ENST00000441833
aggaagacagccaccagcggctgctcatggggctgatggtgtctgagctaaaagaccattttttgagacacctacagggtgtagaaaagaagaaaattgaacagatggttctggactacatttcaaaactgcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatgaaaaagaaaacgcaattggatctgctgctgccattt

SEQ ID NO: 9111 - DNA, 3341 bp, Homo sapiens
  ENST00000373823
gctggagtgcaatggcacgatatcagctcactgaagcctccacctcctgggctcaagcactcctcccacctcagccccccaggtagctgagactacaggaatggataaagcacggagaggaaccaagaatgtgctcagaaaaaaatccttcctcactgaaaccaggactaaggaaaggagattcccttctaccatccatggactcaggctgacggagcacgctgcctgtctgtgtctctccgtttctctctctggaacgttgtcagatgtcacggcggagggaaaagagacctggaatgacttgccgaatttttagcccataaccaggcactgtgtaaaccgctttacctcattcagtctttgcaattataccacaaggtcacactgtttagaaggagaaagaagagctcgctgtgaaaaacgctccacaatgctgcagagccttgtgaaggtggaagagtactctcatcagcaaacggcattccttccatggaaaatgtcattgggaggaaagcaggttcaagtgattctcctgcctcagcctcctgagtagctgggattacagggacaaactacaaggcattcgatgctcaacaaatacttgtgctgataacttctctttctgaagccagctccaggagaggtctgtaatcagaagagcccctgaaccctgaagcctcctgggctgcccagcccaggcatctcctctcctcactctgggaaggaggtggtcttctggcaaaagaagatatcaaagttcttccatcagaggagatccttatcagcaagacattcactctgaggtagtgctcatagctctctttgtccagtgcttcggccttggtcccagcgccttcccacggagcagcactcttcaccctgcacagccttgttagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgt

SEQ ID NO: 9112 - DNA, 1042 bp, Homo sapiens
  ENST00000432226
ctcccccacccgcctgcccggccgccccgccccgagggcggctcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtcc

SEQ ID NO: 9113 - DNA, 2664 bp, Homo sapiens
  ENST00000373808
ctcccccacccgcctgcccggccgccccgccccgagggcggctcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagttcttgcagatacagcgctaggaaaaggggagtaattcaggtctagaatggaaaaactgttttgttgctttcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttt

SEQ ID NO: 9114 - DNA, 716 bp, Homo sapiens
  ENST00000477863
gaaccagctgagcgcagctggacccagcagccgctgtctccagtgccgcagcagcagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccga

SEQ ID NO: 9115 - DNA, 2702 bp, Homo sapiens
  ENST00000449733
agctgagcgcagctggacccagcagccgctgtctccagtgccgcagcagcaggtagtgctcatagctctctttgtccagtgcttcggccttggtcccagcgccttcccacggagcagcactcttcaccctgcacagccttgttaggagaaggggatgaatgaatacaggacttacgcgtctgctgtggcccagctggcttccagatggtgacatgagccacccacagccggagctgttcctctttcccaaagctcagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgt

SEQ ID NO: 9116 - DNA, 802 bp, Homo sapiens
  ENST00000483960
agtgctcatagctctctttgtccagtgcttcggccttggtcccagcgccttcccacggagcagcactcttcaccctgcacagccttgttaggagaaggggatgaatgaatacaggacttacgcgtctgctgtggcccagctggcttccagatggtgacatgagccacccacagccggagctgttcctctttcccaaagctcagacggagtcttgctgtggtgcccaggctggagtgcagtggcacgatctcagctcactgcaacctcctcctcccaggacttttgggtcctttccagttttcttcaaacaatgcttcagtgaacatccttgcacatatatttttgtgtttgttgttcttgcagatacagcgctaggaaaaggggagtaattcaggtctagaatggaaaaactgttttgttgctttcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgc

SEQ ID NO: 9117 - DNA, 806 bp, Homo sapiens
  ENST00000477104
atagctccccccagcctcgcgatggccgaggaagaagccctcaggggcaattctgacccatggttcttgcagatacagcgctaggaaaaggggagtaattcaggtctagaatggaaaaactgttttgttgctttcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccag

SEQ ID NO: 9118 - DNA, 2311 bp, Homo sapiens
  ENST00000394353
atagctccccccagcctcgcgatggccgaggaagaagccctcaggggcaattctgacccatggcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttgg

SEQ ID NO: 9119 - DNA, 2428 bp, Homo sapiens
  ENST00000545652
gtgctcccagggcccacaactgcttgaatgactattggtgttcctgtttgtgtgccctctgggccgggaagtcagagaaagaaaggagacaatttgtgattgaacagccactgtggccatcattctccttacctgtctgatgagagctgatcttcatgccactgtgtacacccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtcctt

SEQ ID NO: 9120 - DNA, 2657 bp, Homo sapiens
  ENST00000373818
gggcggctacttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcggcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 9121 - DNA, 6454 bp, Homo sapiens
  ENST00000485767
gatctttgctctaagaaaacctgatattggctggcacagtggctcatgcctgtaattccagcactttgggaggccaaggcgggaggatcacatgaggccaggagttcgagaccagcctggccaacatggtgaaacttcatctctacaaaaaatacaaaaattagctgggcatggtggtgcacatctgtaatcacagctacttgggaggctaaagcacaagaatcgctggaacccaggaggtggaggctgcagtgaattgagattacaccactgcactccagcctgggcaacagagcgagaaaacctgatattgagagaagaatgtggatcttacagattcagacatgcctgggtttgaattctagctccaccaccttgggcaagtcccgtcacctgtgggccccattttgcacatcagtgcgatgcagcaatgacacctcccttgcaggcgatgcgtgaagaatgcccggcacagtgggcatcatcatttcacaaacacgtatactgctgacacaggaagacagagcaggagcccaatatacacggactccgtttgtcccttgccctcctcgagtctgtgcggctagaattagacttagcacagtgggctgaggggccctggatggggtggctgcattgctggcctgagtggaagccctctgcttccacccccatgtgtctccggagcagggagacgagcacccgattgggaggaggaaacaaggtttccagccttggcttggccacgcacttgctgagtgcccttgagtaagtcacttcacttctctgggcttcagtttaccgtgggtaaagtggggtgaagtagaaggacctttccaactctgatttgacaactctggggcatggagctggggactgctcacaggaaagcccagctgactttccttggcttgcttctgagtgagggcagttgtgactgcagcagggaagctctcctgaacgccttgctctgggatgcagtaatgattacagagggctggggagcaggagcttgtgtctccacttcagaaaggagaggcctgaggctcggaaagggcaagtgacttacccaaagccatccagcattgttgtggcggggcacctgtcccttacccatagctgctctgaagggactgctgggtgggagttgctgcggtaccgtaggggaaagcagaagggtggcatgggctggaacaatccagaaagacttcccagagagccttgaaggatgagaaagatttggattagtacctctcaaagtggcttttgcaaaatactcaagctggaggcaggatatggtgaagaaaagtggttcttgggctgggttcagtgactcactcctgtaatcccagcacccaaggatctcttgaggccaggagttcaagaccagcttaaacagcatagtgagaccccatgtctacaataaaataaaataaaataagtaagctgggcactgtggctcataactgtagtcttagccactcgagaggctgagatgggaggatcattcaagtccaggagtttgaggttacagtgagctgtgattgtaccaatgcactgcagcctgggacagagtgaaaccctgttgaaaggaaggaagagagagagagagcggaaggaaggagagagagagagaaagagagaaaggaaggaaggaaaggaaagagagagggaaagagaatgaaagaaagaaaaaaagaaaggaaagaaaaaagaaagagggaaagaaagaaaagcagttcttggttcaataagatagggaaatactgtataaaacaaaaggcaagcaggtgtattcaccataggatttgacagagcctttattatgcacatgcgcgttgtataacagtcagggagggtgagtgagaagcattccctatgcttatttgaccgtggaactctttccttgcagaatgtcttaggggactagtgtgcctttgggaaacgccggttttgaggaaggaattgttgcagtttttttgatttagaaagtggctacaggggtccttgttagtggagtatgggattcaaaggggtggcagaaagatgcagtgggcagggaatctctcacttcttagctgtgtggccttgggcaaattttattcctttcctaaacctcagtttcctactctgaaacagtctcaaacaagataatgggtatgaaagtcctgagttaactgagaatcactgtgttgctggaaagcccctggtccacaagccagaatttcctttacctcaattctgtccccttcttccatatctgcttccctgggccttctcccctgggctaatgctgtctctttggccccacagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacgtgagtcctgctttcctctttcccaggagccactgaggtgctcctggtctgatcagggacttgggtacatccacgtgaacaaatgcatagatgcaggtgggcaaaccacagggaccagcattgttcacgtacagatatgtctgtatgcaaagactcccacaaatgtagactcacaccacgggtatagtgcgtacttggactttgattgacatatagacttcctggcaccttctgttcatatgtacgtcttgtgtcctttttcacatgcttataaatatataacagtcatgggcaaacactctgggcttttgcccaccaggtgtgcacatgtgcaccatcatgaatgcccacacatgtatactcgggtatgttgtttaaggtcccacatgtgtatgtcatacatgtagttgcacatgcccatgatctatggcaatgtgtgtgggatgcccttacccaggcccaccttatagatgtgtgacgctttgtacacacttgtctcacaaatccctggagcgcagacctgcaaatggacacggcccttctaccccaaagctcatatgcttatacacctgtgatataatgtccgtgcaaacatgagcacacactgatttagtgtaagctttttattaaagcgtcatgggcacacagaggagtgtgtgaatcctgagtgtacagcttgatggattacacagagcgaacacactcacgtaacactggatcatgaagcagaacctcaccagcccctagaaggccccttttgcccctttcggtgccctcaccccaagggcaaccatcatcctgaactttctcaacagcatagatgagttttgcctgtttctgaactttatagacacggaaccttgttcttttatctctgaccttttgctcaacattacatttctgagatgcatccgtattgttgcatttagttgtaggttgttcattttccttgctgtggaagattcagttgtgtgggtgtaccatgatttatgtatcctttatgttgttgatgggcacttgaggtggcttctggtttggggctattacagacagtgctactctgaacattcttgcacaagtcttttggtggacatacgaacgtacttctgtcaggtattttcctagaaggaggattgctgggtcataaggaaataggtatattcggctttagtggctatggccaaatggttttccaaaatggttgtgccaatttatattcccttcagcaggcaaacatttttgcacacattctagatgtagttgtacctgtgaaaaaattcctgtcctcagacatgcgctcccatctcctggtgtgtgcagatcacacttaattgtacgtaaataatgcacgtgtgcagactgtgccagccttcacctgggcaagtgcagaacagggtgagcctgcacaccacacgccacactccccaagccctgtcgctgggcggggcttataggaaggcggggcactgacttcctgggtctctgtcttccagaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgcctgtggggtgcgcaatggggtggccatggggacacgctgctcatgactttcttctgttcagtaggcaatttgaggtgaatttgaggaaaaaaaaaaacttccgctctaccccacctttttatttttaaaatacttttttattttaatttttgagacaggatcttattcattgttgcctgagctggagtgcaggggcgccatcacagctcactgcagccttgacctcctgggctcaagtgatcctcctgcctcagcctcccgagtagctgggaccacaggcgagtgctaccaagccaggctaacttttgaattttttgtaggaatgaggtcttgccatgtcgctcaggctggtctccaacttctggggtcaaaccatcacctgcctcaacctcccaaaatgctgggattacaagcatgagtcaccatgctggccctgcctcacttttgaggctgtttttccatcaaacctgatcactttagggagcaagggagatcagtttcttgcacaactccccgactaccctgagaggtgggactggaacccaaggctgtgctgtgagtgtgagccgcattctccagtggggagggccaggtcctctgcagagctaaggagggcagtctcttagcatccccagagggccagctttgtgctagaataaggtcagaaagagaccactgagccccaatcccctcttttctcttctgactatttctggtagtttttggcccatttagtcacatggtgggattgccagccattgtgcgttgaggacgtatcaatagaggcaagattcactaggaaaaggagaagaccatgagctctgctccatgtcacttggttcctgcttctctgggggcatccaattccagcttttggagagagcagaatggtgattattattatgggaagggacctggacaccaaccatggcttgggagggacagtgggagtgaaaataggctctgaagccacagggatggaggttcagattctggcttagccacctaatagctgtgtgagtaggtgacttcatctttctggacctcagattcctcttctgtaaaatgagagtgataatctgtgcctcctggcctggctgcgaggatgcagtgacatcttttaaaggtaggcggtagaaggtgttcagtagctatagttatcacaattagccggtaggcgaaatatctgaagcgctgtctggaggcagaggagcaggagtgttctcctggagtttctgagtcagggagacaaggtggaagggacctctgatggacagatctggacatgtgagcagatgcaggatgtgtctggaggaggtcagactccatggggagggtcacagtggatgtccttgtgatccttgcctgcctgggagctatctcaggagcctggcccctccctcacagccacccttcctctccatctctctatctcctacaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggtactggagacagggaaagggtcccaactggcctgtaggatcttggatgggatgttctgcagctcccaggaactcagctcccggggagtgtggagtgtgcctggtgcaatggaaatcagaagtcttgggctgaggccttggttttgcatttgacatactgtgtgatcttgggcactttacttaccctttctgggcctcagattcctgatctgggctaaaatgggtgtttcccaagtgcattataacgtcagttctctgagaggctaattggcatcctgtagaaattatgtagaaaacatctaactgtatggtcagataaattcatgggcaacagtggattttaaaatgttcgagtttgtttactgtaggacttttaacttgttcatttacaggggggcttttcatgaagatgatctggtttgggaaatgctaagctagaagttcataaactctttcggtactatcttgtgggaattctcttggaaaccattggcccagatgtttcccagaggccctgagatgttctgagaggacccatcaatatcctcccctgattctctaaggctcatcttggggaagaggacagaggagagggaggcagtaggaggacagagagaaagggagacggtggggagaaagagagagagagagacactattatgattatt

SEQ ID NO: 9122 - DNA, 2823 bp, Homo sapiens
  ENST00000373807
attaaagcgtcatgggcacacagaggagtgtgtgaatcctgagtgtacagcttgatggattacacagagcgaacacactcacgtaacactggatcatgaagcagaacctcaccagcccctagaaggccccttttgcccctttcggtgccctcaccccaagggcaaccatcatcctgaactttctcaacagcatagatgagttttgcctgtttctgaactttatagacacggaaccttgttcttttatctctgaccttttgctcaacattacatttctgagatgcatccgtattgttgcatttagttgtaggttgttcattttccttgctgtggaagattcagttgtgtgggtgtaccatgatttatgtatcctttatgttgttgatgggcacttgaggtggcttctggtttggggctattacagacagtgctactctgaacattcttgcacaagtcttttggtggacatacgaacgtacttctgtcaggtattttcctagaaggaggattgctgggtcataaggaaataggtatattcggctttagtggctatggccaaatggttttccaaaatggttgtgccaatttatattcccttcagcaggcaaacatttttgcacacattctagatgtagttgtacctgtgaaaaaattcctgtcctcagacatgcgctcccatctcctggtgtgtgcagatcacacttaattgtacgtaaataatgcacgtgtgcagactgtgccagccttcacctgggcaagtgcagaacagggtgagcctgcacaccacacgccacactccccaagccctgtcgctgggcggggcttataggaaggcggggcactgacttcctgggtctctgtcttccagaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctggtgaggacccgagtgcctgggggcggggggaggggtccgttgcttgtggggtgctgggagtggctcctgtacaggtctgggaatgagcatctttccaggggactgatggacaagatagggtggggacttcctcctctgtgggccagcccctcataaatcctgcctgggatagtgaagaacacatcagttccttcagaaaccctgaggcttctcaaagaaggctctcctctgttccaggagaaggaagggacagatgagaagtcacttcaagttcccagaatactcagaagctgaacttgtcaaggtttagatgtggcaaagcaggccaggcatggtgactcatgcatgtaatcccagcattttgggaggccaaggcaggaggatcacttgagcccaggagtttgaaagcagcccgggcaacatagtgaaacctcatctctag

SEQ ID NO: 9123 - DNA, 879 bp, Homo sapiens
  ENST00000373806
acaagggcggcacctcccgcgagggcgggcagacagcccctgccagcacccgcctcttccaggtccgcgccaacagcgctggagccacccgggctgttgaggtaatttccaggtcctggaacacagaagggattggcctccctgaaacctcccagctcaatgaccagatctccaggcacaggaacgggggcaggggatggtgaatgacggggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctca

SEQ ID NO: 9124 - DNA, 680 bp, Homo sapiens
  ENST00000477553
tggcgtcccttggcaactggcgtggcctcccctcacagatggcttctgggaggccctgggcgggaaggctgcctaccgcacatccccacggctgaaggacaagaagatggatgcccatcctcctcgcctctttgcctgctccaacaagattggacgttttgtggtgagcccctgcggaggtcacacctctgctttcccctcgggaggcgagttccacaggactggccggcagcaggggcaggagaaacagttctgatggtgtggcacagaggaaggggccccctgccagctgcagccagctgtgccactccctcagggggcagataaaggaaggccacccaggggagggaagacatctcactgatgctctttcgttccttcccagatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctg

SEQ ID NO: 9125 - DNA, 556 bp, Homo sapiens
  ENST00000434663
acacaggctggagtgcaatggcacgatatcagctcactgaagcctccacctcctgggctcaagcactcctcccacctcagccccccaggtagctgagactacaggaatggataaagcacggagaggaaccaagaatgtgctcagaaaaaaatccttcctcactgaaaccaggactaaggaaaggagattcccttctaccatccatggactcaggctgacggagcacgctgcctgtctgtgtctctccgtttctctctctggaacgttgtcagatgtcacggcggagggaaaagagacctggaatgacttgccgaatttttagcccataaccaggcactgtgtaaaccgctttacctcattcagtctttgcaattataccacaaggtcacactgtttagaaggagaaagaagagctcgctgtgaaaaacgctccacaatgctgcagagccttgtgaaggtggaagagtactctcatcagcaaacggcattccttccatggaaaatgtcattgggaggaaagcagggacaaactacaaggcattcgatgctcaacaaa

SEQ ID NO: 9126 - DNA, 903 bp, Homo sapiens
  ENST00000490021
cttatactctgagccctgctcggtttaggcctgtctgcggaatccgcaccaaccagcaccatgcccatgatactggggtactgggacatccgcgggctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgaaaagtgtaatgttggttggagctcgagaaggaatctggatactgtgtgccggaccagccaaagaatcctgtgtcaaaaccgagagaacgaataagccttcatcaccatggcacatttatataaaaagaaagggagagatgttgcgggaagtcagggaccccgaatggagggactgactggagccgcggcagaggaacataaattgcaaatatttcattttaatatggacatttatcagttcccaaattattactttttacatttcttacgcctgtcttactttaatctcttaatcctgttatcttcataagctgaggatatatgtcacctcaggaccactgtgataattgtgttaactgtacaaattgattgtaaaacatgtgtgtttgcacaatatgaaatcagtgcaccttgaagaagaacagaataacagtgatttttaggcaacaagagaagacaaccataaggtctgactgcgtgcagggtcaggcaaaatagagccatatttttcttcttgcagggagcctataaatggacatggaagtagggaagatatt

SEQ ID NO: 9127 - DNA, 1161 bp, Homo sapiens
  ENST00000309851
ctctgagccctgctcggtttaggcctgtctgcggaatccgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 9128 - DNA, 852 bp, Homo sapiens
  ENST00000369823
ctgctcggtttaggcctgtctgcggaatccgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatgggatgctggggagcctggtggcccaactgagcttcgccggtttcccatccatccagctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctg

SEQ ID NO: 9129 - DNA, 1028 bp, Homo sapiens
  ENST00000349334
aggcctgtctgcggaatccgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaacca

SEQ ID NO: 9130 - DNA, 491 bp, Homo sapiens
  ENST00000476065
tgtctgcggaatccgcaccaaccagcaccatgcccatgatactggggtactgggacatccgcgggacaaagtcagggaccctccatctctgacgcgacctgcgggccatctctcccagctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagc

SEQ ID NO: 9131 - DNA, 512 bp, Homo sapiens
  ENST00000483399
tgtctgcggaatccgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatgtggggagacagaagaggagaagattcgtgtggacattttggagaaccagaccatggacaaccatatgcagctgggcatgatctgctacaatccagaatttgaaaagtgtaatgttggttggagctcgagaaggaatctggatactgtgtgccggaccagccaaagaatcctgtgtcaaaaccgagagaacgaataagccttcatcaccatggcacatttatataaaaagaaagggagagatgttgcgggaagtcagggaccccgaatggagggactgactggagccgcggcagaggaacataaat

SEQ ID NO: 9132 - DNA, 871 bp, Homo sapiens
  ENST00000490171
tccgcaccaaccagcaccatgcccatgatactggggtactgggacatccgcgggctggcccacgccatccgcctgctcctggaatacacagactcaagctatgaggaaaagaagtacacgatgggggacggtaatggcaccctcgtgttcgggctctgcccactcacgctaagttggcaccaagcaacccatggtggccacctgtggctgcctctgcaggcctcccctgctggagctgcaggctgtctcttccctgagccccggtgagggagccctctggccttgcaaggcagaatgctggggtgggatgctgggccccctgtctaattgggacgggtgtccctcagggcttgcctaaaccctggaagccttagctgtgtggggtccagagccctcagcgggattctttgtccctgaaccctgggatgtgggactgagtggtcagattctagatccacctgtctcagggatcttgccactggctccgtgggagggtccccgggaaggagggctgggctctggggaggtttgttttcacttcttcttccccaccacagctcctgattatgacagaagccagtggctgaatgaaaaattcaagctgggcctggactttcccaatgtaggtgcaggggaaggggcggttttgggggaaagtgcaacgtgtctctgactgcatctcctctccccagcttagaggtgttaagatcaggagtcttctgcccaattcctctcactcctggctgtctaaacagtccttccatgatgttctgtgtccacctgcattcgttcatgtgacagtattcttatttcagtcctgccatgagcaggcacagtgagtgcccggtctcctctctgctcttgcttatgg

SEQ ID NO: 9133 - DNA, 790 bp, Homo sapiens
  ENST00000369819
cgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcct

SEQ ID NO: 9134 - DNA, 1179 bp, Homo sapiens
  ENST00000338595
cgcctccttgctgctgctgccgccgccaatcctggtccggttgcccgagttcccggaggtctctcgcgggacctctctcaccgccaccgctcctactctcgggcttccaaatctggggcgatgtctccccaggttaaattaccctagctcctgctccagatcgcttccccgtgccccgccagagcccagtagttcaaaaattaaatttggggcaaggggtgcgcgccagagcgcagctgtttctggagcctgcggcagcggtggcgagccacagggcggcgaccgtgagctccgggagctgcgcaaaccacctggagaccatgtctggggatgcgaccaggaccctggggaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaggagtgcctggtagcgttgagatgtgggagagaatgcactaatctgaaggcagccctgcgtcaggaattcagcaacctggaagagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacagg

SEQ ID NO: 9135 - DNA, 669 bp, Homo sapiens
  ENST00000473401
gcaaaccacctggagaccatgtctggggatgcgaccaggaccctggggaaagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaa

SEQ ID NO: 9136 - DNA, 763 bp, Homo sapiens
  ENST00000477078
ctggggatgcgaccaggaccctggggaaagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaggagtgcctggtagcgttgagatgtgggagagaatgcactaatctgaaggcagccctgcgtcaggaattcagcaacctggaagaggataggaagaaaagaaagtttatacctggttaattcgtcactgaaaacaattttctgaatggaattaccagatcaaagggtataatgagcacattggaggcttggactgtatttcactaaattgcttcccaaaagacttgtgttgtttgcccctcaccagcacaagtacagcagcccccactgggagccaccacactgtttcgagattgggggcttgggatttcttggcaatggtgtagaggatggtgaagatttcttcatcctccggttgaacgttcttggggagccgcggccgacgcgcctcgcactgatggccaccagggggagccccgcgcgcttcctccttccccttgtgttccagggcgcacttcaaaacgctgacgttctccttcgtccctctgggggcgc

SEQ ID NO: 9137 - DNA, 6423 bp, Homo sapiens
  ENST00000369707
gctccttcctcaccgggctgactagcctctcctttccctgtccccctccatcgctgctctgcaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaggagtgcctggtagcgttgagatgtgggagagaatgcactaatctgaaggcagccctgcgtcaggaattcagcaacctggaagagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgtattcttctgataatcatttgtctgactcctctagcctgtagctgctgctactgctgcttttttttcctttttttttttgaggcaagatcttgcttcgttactcaggctggagtgcagtgggacagtcggctcactgcagccttgaactcctgggctcagttgattctcccgcctcagcctcctgagaagctaggactacaggtatgtgtcaccacgcccagctaatttttaaaaaaatgttgttgagacagggtctcactatgttgctcaggctggtctccatctcctggccgcaagccatccacccaacttggtctccaaagtgttgagattacaggcatgagccacctggcctgcctagcctgtagcttctaactattttctagaaagtgcctggtgctaatgtcagagcacattttgggagcctgtgtgcctcctaactccttggccttcagcctagtttgatctccagattattggtgcagatgctgatgctgaggttcagggtcaacctatgactgatgcttgtcactacagaatggcaccctccaaagacctccctggtgaaagcttaagaagagggagaaggaagaagaaaacactccaaacctaaataccttccatttggcaaatgaatgtcgctgtccacgtgggcgagtatgagtgtaattctccaaactttggccatgggcctggagacaccgagggtcttgtgactggaaagaattccaaagcaggaaatgaaacaccggtttatcacccaggactaactacgtcagaatttcactggtgctgtcagggctcaggatgtctcacaaaatgttctatagccggcatcctgccttaaaaaaatacacacgccccaaacccagccacaagcaaaggtcattccgttggatttgcgtcacactctcttccaattcatctcaacaaatgcctctggttgcctgttgtgtaccaagcccaggggcacactggggataaagttgaaaaagacattggctctgtccctgggagcccccatctctccacttatcttggttgaggttttaaacctagcgctttggagctgcttgtctgttgtagggatgcttgtctctgatgtggcccctctgccagcttcgccaggcagtaccaccccactgaagacagcaaagagctgaggatggctggtgccaacaggtcccttgggctgggagcatctactgcctgcactatgggagggggaccaagtttgtccaatgctgtttcatctcagtgtctgaggatcagcctgtgatcatttcagctttgctcatgctggatcctttcccatcctcctagctgtgctgagacaccaggcagcaacaggagcgatgttttgccttgtctgtgctccctaaggagctgtctgccacctctgcctctgagacagcccaaatcagccctcctctctccccacgtctcagtctggccctgccatctgctggctctgggtatattttgacccatgtaaatagttaccaggtgttactctgtgccagctggacagaaacaagcctgcttggtgaggtggccagaacttccagaagaggcagcgcatgacaggggcagtctgccgcaccatctgctccggatgtggagccctgttgccatggcaccctagttaatgctgagtgaggtctgtgaatcaccgttttcctgggatctttgctccaagaagaggggaatcttctcctgtggcctctcataggacttaggagattgatcagccttttgccggtacaaatcctgcatgctagtgagtgcttgtcataagaccaaagttaccactgatgcaacaggaaatggcatgcctctggctcaccaaaatgaaggtgttctcttttggggctccgcacactaatttagaaagcttgaagaaccaggaattatagaatggagaaaagcactcatgggggaggtttgcagcctggtggcctatagcccagtttgggatttgagtgcctcttggccaggcatgctccctgctgtttaccagggtcctggtcacctgcacatccttacacttcctccatctcgcttctttgtcacttgtctgacccacagagaaaactgagttatcaatctttgaataaaactagaaggatgtggcctggagaaaagagggaaggaggtaattaaataatgctccatgaagaactttaaaaatatgcttcttaattaatacatgtggaaagaatacatatgggttaaaaatacaataatgtaaaagaatagaaaatcttccattatcttgtgtcctagagataaccacttttagtaattggtgtctacctttttttccccttttcttttaaataatagagatggggtttcgctatgttgaccaggctggtcttgaactcctggcttcaagtgatcctcccatctcggcatcccaaagtgctgggattataggtctgagtcatcatgcctggtgggtgtctatcttataaaaagcactaaacttaaagatttaaaggtgagagcctgtattaggccattctcatggtgctataaagaactgcccaagactgagtaatttataaaggaaagaggtttaattgactcacaattccacatggctggggaagcctcaggaaactttcaatcatggtggaaggggaagcaaacatgtccttctgcacaaggtggcagaagagagaagtacagagccaaagagggaaaaactccttataaaaccattagatctcatgagaactcactcactgtcatgagaaaagcatagggaaaacactcccacaatcgaatcacctcccttgaggtccctcccccaacatgtggggattataattcagattaaaattgaagatgagattttaggtggagcacagccaaaccatatcagagccattctctatcttttgcagattggaaaaataaaaaaattagtttaaaccacagcatttaaaagaaatggtcatagatgatgttaacatcagaatggaggttgtgtggagttcccctccttggaggttctgagctacagcctagcctggactcagtccagttacaatctaacatggctagggggaggagggagcatgatggggcagggcttgtgtggctgggacagctggctatggtcgtggtgctggtgactaaatggtacttgaaatttcttttagatctaaaattctgtgatatggtttggatctgagaccccaccaaatttcgtgttgaaatgtaatccccaatgctggtgggaggtgattggatcatgggggtagatttctcatgaatggtttagcaccattctcttggtgctgttctcatgatagtgagtgagttctcatgagttctggttgtttaaaagtgtgcagcatctccctgacccctcttgcgccagctcccaccatgggagatgcctcgctccccctttgctttttgccatgagaggaagcttcctgagggctctccagaagcagaatctactacacttctcatacagcctgcagaaccatgagccaattaaacctctttttaaaaacacttttattttaagttcaggggtacatgtgcaggatgtgcaggttcgttccataggtaaacatgcgtcatggggtttgttatgcagattatttcatcacctagatattaagtctagtatccattagttatttttcctgatcctctccctcctcccaccctgcaccctctgataggcctcagtgtgtattgttaccctccacatgtccatgtgttctcatgatttagctcccacttataagtgagaacatgcagtttttgtaaacctgttttctttagggaaagtttagaattttctagagactggttgtatggttgtgaccaaaatgccagtagtgatatggacagtgaaggccaggctgaggaggtgatggaaatgaggaacttactgggaactggagcaaaggtcacttttgttatgctttagcaaagaacttggctgcattgtgctcctggcctagggacctgtggaagtttgaacttgagagtgatgattttagggtatctggcagaaaaaatttctaagcagcaaagcattcaagatgcgccctggctgctttcaacaacctatgctcatatttgtgagcaaagaaattatgttaagttggaacttatatttacaggggaagcagagcgtaaaagtttggagaatttgcagccagctatgtggtagaaaagaagagcccgttttcagggaaggaattcaagcaggctgcagaaatttgcataagtaaaaaggagccaagtgctaatggccaagaaaatggggaaaaggccttgaaggcatttcagagacctttgtggcagcccctcccatcacagactcagaggcctaggaggacagaatgactctgagtattaaagtagatttaatctaaatcataaagtacaagctagagcaatccctccagtgctgcagaaactgcctgcatgtggctcccacattgtttcttggagctttggtggtggtaggggtggcaggggcaggtgttatgtttcttggtttctcaccttcaggtctccttacccatgtttcctttgtcagagtcattggccttgatggaggggagactgggttactctgagttgagaagcaagcttgactgccctgtggtttatatcagcctagcttagtttgttttctgaagtcttcacaaataaccaaatatccagcccagtgcagttctcaatgagtagtctccagttcccatcccccaccacacacacacaccaaacactgtgcccacctgggagacccattttcatttatcttcttctttgagtgcctggaaggctgaacatttgatcttttcaaacatttttctctcatctggcctgttagcgctcttgagcctttgaaaatgccatttcctctacatactattcttcctcagagcagccctctgtttttttttccaaccagtcttttctcttgcaaagttcagatcaaaattcttctttatgtaaagagaagtggcgtgccataggggttacaaacagggcttcaaggttagcactgggatcaaattccgactttgcaacttaactttcttgagtaagttgctacacctctattagcctcagtttcttatctgtaaaatgggacggctaagtacctatttcattgggctgttgaataatgatggtctcatctatgcaagggcttagtaccagctgggtgaaactcagtgaatggcaggcaaccctattatgactaggcttctgccaatgatcagacttgaaccctgtgctcatccccccatcactttgtggaactagatgtcctacgttgcacatggcttgattcatggtttggagttgttttctggttgtttcctgtgtgcaggtttaatctcaacctgtgatcccttgaaagctgcaattttatccctccccgtcctcctccctctcaccccaaggccaagtttaatactgtgcattctgaaatcttgcaatgttgatgatgtaaaataaatcttctctcctgtgtttctgaa

SEQ ID NO: 9138 - DNA, 576 bp, Homo sapiens
  ENST00000467629
aggaagaaaagaaagtttatacctggttaattcgtcactgaaaacaattttctaacacctctgttctgtaaagcagaagagctgtgtagatgttccagagtcgcttggtgtaaatttggttctgatttgtgccgtgaagcccaataacaaactggaggcacacatttcaaagccagtgattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgta

SEQ ID NO: 9139 - DNA, 2694 bp, Homo sapiens
  ENST00000498052
ttagtgccatcctgttagcttccttgaacaaggtaatgccacctaacatgttttttcagacttccaggacaatgatcagggggacttctctatgccacactgggaggtgtgaaggtgtaggctttagggcaacccctctgagaaggggtggcaggtggaggagcccattgatcctttctatcagggatggatttgctttctgtgggtgtcaccttcaggggcctgtgttcccactcatcacaggagctcatatttactcagtggggccagagtgttcttcatacatggtgattttactcctcaccataacctccgtggtgcgtgctaacatgaccaccattttgcagatgagaacatggaggcttgcaggggaggtaagttgccccaggttccatgctgaatcagaggtcaagctcagcacacagcacaggaccaagtctgctggttcccaagctcacatccttacctacaactctgaatcaccccacagcagagtcaacaagctggcctggcatgtgaagaagcaagcctgggtgtctcctggctgccagtgccatccctgccccgggaccctaatccacagtttgattctggtccttttgccctctgtccctcaccagaaccctgatatttccagatgaaaacacgagtatagcttatttccacaactcacctgggcccagcaatcaagatctatagctatagggaagtattgagttgattatgagttatataggtcaaaatgagtagcttgcttgattgaagcaggtaattcgtgccatacttttctctttgggaagacctgtaccaacaataacctctgctaaacactttcgcttttttaaatttgcaggtacttttttggggctgtctttggctgcctgtctgttgagagtttgttttctttacagtccatctgatttacagtccctccgggttgatttgtctcatttgggaatgagaaattttattttaatgcattaagtaatagtgttgagtggccaacaaatgtgaagtttgaaaagctcaaatgaaaaaaaaagtgtgatagaaacacagagttgggggccgggtgcagtggctcacacctgtatttccggcactgtgggaggccaagacaggaggatcccttgagctcaggagtttgagacccctgggcaacatggcaagaccccaagaccccatctctacaaaaaaaatgtaaaaatcagccaggggtaatcccagctacttgggaggctgaggtggaaggattgcttgagcccgggaggttgaggctgcagtgagctgtgatcgatctactggactccagcctgagtgacagagcaagaccctatctaaaaaaaaaaaaaaaaaaaaaaaaagaagaagaagaacacaggttggaatttgagggggcctgttaaataggatgctctttcctgccttagttttgaattaattgagaagataaaataataaggcatggagattagagcatcccctttctttttttctttttcttttcttttttctttttttcttttttactttttgctcttcttggccaggctggagtgcaatggcacaatcttggctcaccacaacctccgcctcgcgggttcaagcaattctcttgcctcagcttccccagtagctggggttacagccacgtgccatgatgcccagctaattttgtattttcagtagagacggggtttctccatgttggtcaggctggtctcgaactccccacctcaggtaatccacccgcctcggcctcccaaagtgctgggaatacaggcatgagccaccaggcccggcagcatcccctttcttattgataaagcagatcttggagaatgggagatcctgagcggggttcctaatgctagccttcaacatcaggctgaggctcaccttgtcttcaagtaatgggcagtgctggcctgaaggggagcctcctctgtccagggctcagcttatccttggaaggcttagcacattgaggagctgctccaggctaagagggagggactggggtactctgtagaggttgttcttccagtttcttcaatcagatgagccacactgtcactctagtgttgaaaggagggaagggacagaggtggccaggagtgtgaccctaaaagaggcagaggagacctcagagaaagagaagaagcattctcctaaccagagggagaaggagagaggcctcagttctccctctctgggaattaatttgagatttacatttagtgtctataaacatgtcagcagatatataaacttatttgcttttgctttgtttccatttttagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacagg

SEQ ID NO: 9140 - DNA, 1391 bp, Homo sapiens
  ENST00000450629
accacctctgctgccgcgcgcctaccggagccgcttggccctagtgctttccagcggatttcccctcaggtgcggagccgggtgccggggtcccacagccaaccactaccggttcctctttcgtcagccaccggcgccggcaggacccgcgaatcccgatctccaggagcctgtaaggaggccgcccattggctcagccgcactgctgggcaggtacttccaaagctttgaggattggctgatgctctgggcgccggggctagttggcgggtaggatcacgtgcgaggggcaggccccgtctaggccccgcctccttgctgctgctgccgccgccaatcctggtccggttgcccgagttcccggaggtctctcgcgggacctctctcaccgccaccgctcctactctcgggcttccaaatctggggcgatgtctccccaggttaaattaccctagctcctgctccagatcgcttccccgtgccccgccagagcccagtagttcaaaaattaaatttggggcaaggggtgcgcgccagagcgcagctgtttctggagcctgcggcagcggtggcgagccacagggcggcgaccgtgagctccgggagctgcgcaaaccacctggagaccatgtctggggatgcgaccaggaccctggggaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgt

SEQ ID NO: 9141 - DNA, 1663 bp, Homo sapiens
  ENST00000302945
gtgggcgcagagggcgggctggctgcggggcgaccgcgcgccggggccatgccgcgctccttcctggtggactcgctagtgctgcgcgaggcgggcgagaagaaggcgcccgagggcagcccgccgccgctcttcccctacgctgtgcccccgccgcacgcgctgcacggtctctcgcctggcgcctgccacgcgcgcaaggctgggctgctgtgcgtgtgcccgctctgcgtcaccgcctcgcagctgcatgggccccccgggccgcccgcgctgcctctactcaaggcttccttcccacccttcggctcgcagtactgccacgcgcccctgggccgccagcactctgctgtgtcgcccggggtcgctcacggcccggccgccgctgctgctgccgccgcgctctaccagacctcctacccgctgcctgaccccaggcagttccactgcatctctgtggacagcagctctaaccagctgcccagcagcaagaggatgcgcacggctttcaccagcacgcagctgctagagctggagcgcgagttcgcttctaatatgtacctgtcccgcctacgtcgcatcgagatcgcgacctacctgaatctgtccgagaagcaggtgaagatctggtttcagaaccgccgagtgaagcacaagaaggagggcaagggcagcaaccatcgtggcggcggcggcgggggtgccggtggtggcgggagcgcaccgcaaggctgcaagtgcgcatcgctctcctcagccaagtgctccgaggatgacgacgaattgcccatgtctccgtcctcctcagggaaggacgaccgggatcttacggtcactccctaggcgcgtgtctccctaggtcgcccaccccaagacctccctgcgcctcggagactagtcctgggactcagcgctgattcccaggcacccgcagccaaaccactgcctggcatggatttggcactgctttgcagaggtcccgggcctgggcagggctgagagcttggcagagactggaccatggcgtccccgccccagggctcgctcgtgtccaaagccaactccaagctgtgaacactgtaagcgctcgagtcctcctgggcagtgcagcaccgcggcccccgcccgcaagcctgcttggcgcagcgccttgctggcagccggcgcctcctagcccgccctctctgggctggcttgggcttcctcgcttactctactctcctccgctctcggtcaaggtcggcggccttggatgctcgttcgcttctctttttaaaatgtctttttgtccctccccacctctttcctgtgatcatttattcactcggcccccgcccgccaacacacacatttatgaacccccactttttttttccttctccttttcccttcccctcctcagggagcctcctccttcagtcagtccatttgtcccttgatctggccttgctgtcctcagtccccacggctcctctcacagatgataaatttcgcccgtagtatccatattggggaaacagatttgctctgtttccaacacgctcttccttcctctaaacataggaccccgctctgcgccgctggcgaccccactcttccccctccagactctggcccgccccagcctagctgtgtaattgtacggcctctgcaatgccagaag

SEQ ID NO: 9142 - DNA, 571 bp, Homo sapiens
  ENST00000448460
aaaacgtgcccagtgtttccctccgagggcactgcgtgccgcgcaggcgcaaagggccaggtgctggaggtgctgtcatggcctgcctcaacccggtgctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaat

SEQ ID NO: 9143 - DNA, 1082 bp, Homo sapiens
  ENST00000437125
aaaacgtgcccagtgtttccctccgagggcactgcgtgccgcgcaggcgcaaagggccaggtgctggaggtgctgtcatggcctgcctcaacccggtgcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacaggttggataccattagtaaatgagtactcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaag

SEQ ID NO: 9144 - DNA, 1639 bp, Homo sapiens
  ENST00000403751
gcgcaggcgcaaagggccaggtgctggaggtgctgtcatggcctgcctcaacccggtgcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaattacac

SEQ ID NO: 9145 - DNA, 473 bp, Homo sapiens
  ENST00000423675
aaagggccaggtgctggaggtgctgtcatggcctgcctcaacccggtgctctgggaaaccaaggttttgcagtctaaagcaacagaagacttcttcagaaatagcatccaatcacctctgtttactcttcagttgccgcacagcttgcaccaaacattgcaatcgtcaacaggttggataccattacatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatgg

SEQ ID NO: 9146 - DNA, 600 bp, Homo sapiens
  ENST00000468326
aggtgctggaggtgctgtcatggcctgcctcaacccggtggggctggggctcttcttcacgtctgtgttggaggaagctgctgagggccagtagttcagcaggaagttgggccagccccgccaaaagaacaacctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggc

SEQ ID NO: 9147 - DNA, 532 bp, Homo sapiens
  ENST00000508440
agcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataaggcattcccaagaaggacatcgtttaacacctaaactcatttaacaaaggatccgagaagaacagggacagtgtgggaagaaatcttcttgtgatggcatatttgcttcctatatttcttctggaatcatgttcgcttggcttcctgattaaaaacacagttttattgctctctgcactgccaaaccaataaatttacagaagagaaagctgtattccactgtaccccttgcagcatcaataaaactgacagccaaa

SEQ ID NO: 9148 - DNA, 1575 bp, Homo sapiens
  ENST00000430487
aaaacgtgcccagtgtttccctccgagggcactgcgtgccgcgcaggcgcaaagggccaggtgctggaggtgctgtcatggcctgcctcaacccggtgctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaattac

SEQ ID NO: 9149 - DNA, 1351 bp, Homo sapiens
  ENST00000370500
acgactgcgtgggtgagtcgtctataaaaactcatctctgcgcgtctcttcgccacattcgcttcctgctttcggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaactggacttggttcctgggaggagccccatctctgtggcagcggcagctatttacatggcctcacaggcatcagctgaaaagaggacccaaaaagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaactcaa

SEQ ID NO: 9150 - DNA, 770 bp, Homo sapiens
  ENST00000448623
gcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccagaaattggagatattgctggtgttgctgatgttacaatcagacagtcctatagactgatctatcctcgagccccagatctgtttcctacagacttcaaatttgacaccccagtggacaaactac

SEQ ID NO: 9151 - DNA, 893 bp, Homo sapiens
  ENST00000494819
tgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagtttgcagttacatgtgaatatgtgataatttgttcagtgttgctcactgacttccactaccaaagctcagtttagctgaagactatacttaaccctttattcatccaaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaactggacttggttcctgggaggagccccatctctgt

SEQ ID NO: 9152 - DNA, 783 bp, Homo sapiens
  ENST00000418217
actcatctctgcgcgtctcttcgccacattcgcttcctgctttcggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcc

SEQ ID NO: 9153 - DNA, 528 bp, Homo sapiens
  ENST00000486078
tctcccgacccgtagccctgctctgctacgactgcgtgggtgagtcgtctataaaaactcatctctgcgcgtctcttcgccacattcgcttcctgctttcggtgtgtctgttgtgtcttgttgcgggcaccgcagtcgccgtgaagatggcgtctaccagccggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgtaagttcttgtctacctcctttaagccattctggcattgactttgcataatttaatgaacacatgaaattttgatattgcagc

SEQ ID NO: 9154 - DNA, 593 bp, Homo sapiens
  ENST00000471296
tttaagattaatgtgtcaaaaaaagatgaatgtgtcttctgcaaactgctttgttgttcaaaataaattgagctaattattaatatcacagataacaagtagcttttgaaacaatttcttgaatgataaattcaataactcaattctggactaaaggaaatcatcaagtcttaagttcagcagagcaacttctaccatccctcatttctatacttactgggttcagtgtactatttaaatctgttactaaagtagttaacaagtagaaaaatacagagagaaattgttctctgactagagaaataagtggcaaagagcacaaactggatggtaatgtaaatgctgcaggttattacgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattg

SEQ ID NO: 9155 - DNA, 516 bp, Homo sapiens
  ENST00000471471
ggctgggggcggggtaggtggtggccgtgagaaggtagccgtgagaaggtgggagaggaaggggtggttaaactattagggatgcaggctttggcaccactacgaagccagggttttctttgtgttttaactgtcagattgagagtagctctgttgtagcccctttgcagggttcccatgagacttttcctaggtagttacgttgactcgcttagcaacatagcaaattacagaaacggagtaagaacgtaagaaatcgcaaagcacgtgacgtatgggatctcactgttcttggcccttctcccgacccgtagccctgctctgctacgactgcgtggtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatct

SEQ ID NO: 9156 - DNA, 516 bp, Homo sapiens
  ENST00000496137
ggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaaagagcagctgatatgtaaattgcaaagcccaccccaggaataaagaaagaaaatcttacatca

SEQ ID NO: 9157 - DNA, 1394 bp, Homo sapiens
  ENST00000419497
tgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaataca

SEQ ID NO: 9158 - DNA, 1850 bp, Homo sapiens
  ENST00000432918
tgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggtgagagggacctggccttccatttctccagaggtcagaaaagagggaggcctgccccagactggcagagaactccttgatcccacaatgggaataaaaccccacttagggtgggtagcggcctgataggcctctggagggtggagagccacggctggcagagaatgggacagaaggcactggccaggggagtgaccacttatttgctgcaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaataca

SEQ ID NO: 9159 - DNA, 2816 bp, Homo sapiens
  ENST00000476510
gtgggaattgaggggaagtagggattgggtctgtacagtgtatggtaactgctcactgtttcttttcaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaataca

SEQ ID NO: 9160 - DNA, 2933 bp, Homo sapiens
  ENST00000307126
atggactcgcgggtatcggagctgttcggcggctgctgccggcccggagggggcccggccgtgggcggaaccctcaaggctaggggggccggcagcagcagcggctgcggggggccaaagggaaagaagaagaacggaaggaacagagggggcaaagccaacaaccccccgtatttgccccccgaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaataca

SEQ ID NO: 9161 - DNA, 721 bp, Homo sapiens
  ENST00000459959
gtggatgaaatctacacagtaccagaggtggggactgttgttggaggaacactttccagattaggctttcactatcagaagagctggagaacggtagtctgttggctttggagggaagaaacagtattgctgcctattggggaatctccaggcccctgagagagaagtgtgggtcttgagctccaggaagaaaactagagtgtattcaactgacttcatctcacacagggaaatgagagacgtcacttaagactcttctttctttctttctttcttttttttgagacagagtctcgctctgttgcccaggctggattgcagtggagcgatcttggctcactgcaacctctgcctcctgggttccagcaattctcctgcctcagccttgagtagctggaattacaggcgcctaccaccatgcccggctaatttttgtatttttagtagagatggggtcgtcaccatattggccaggctggtcttgaattcctgacctcaagtgatccacctgcctcagcctccccaagtgctaggattacaggtgtgagccaacgcggctggcctaagactctgcaaagcagagaatgaaacccaaggggataacttgctccttcagtgattaggtgttcggtgttgttaaaccagcaagtgtctctctgtccaccatcactgctggccttttatgaaattagtcttctgattctgaactctggcagtgagc

SEQ ID NO: 9162 - DNA, 946 bp, Homo sapiens
  ENST00000442748
cccagggaggaggggcacgggaggagaacacctctttcaggtcccgggaccccagggaggaagggcagagactggactctcaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcac

SEQ ID NO: 9163 - DNA, 898 bp, Homo sapiens
  ENST00000480263
ggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtgcatgggatcaatgggacccaatggggccagactctgaggatgggatggtagtagtgaaggacataggatgggggtagagtgtggagactttttgaaatagtatagatgaatgccctgaggggactgtgaacaagctctgcccctcttaggaaatcaatggggaatcaactaaattaaataaaaaatggggtcaagattaagaggcagggtcacccagggaatggtttaggtcctggcaactctgaaggggttggaagggctggcaggaggcactgagggccctgggccctgggccaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccag

SEQ ID NO: 9164 - DNA, 681 bp, Homo sapiens
  ENST00000452781
atggactcgcgggtatcggagctgttcggcggctgctgccggcccggagggggcccggccgtgggcggaaccctcaaggctaggggggccggcagcagcagcggctgcggggggccaaagggaaagaagaagaacggaaggaacagagggggcaaagccaacaaccccccgtatttgccccccgaggctgaagatggaaacattgaatataaataccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagag

SEQ ID NO: 9165 - DNA, 2830 bp, Homo sapiens
  ENST00000307114
gtttcctagaccagtgacaaagaaaggttttaacagcctgggcacagaggagacatagacttctgggaaaagcaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgctt

SEQ ID NO: 9166 - DNA, 470 bp, Homo sapiens
  ENST00000582578
ggaaaacagctacggagggaaggatgagaagcaatgcaaagtgacatataccatcctggccacagcttcccaagttgggtcctttgctgggtgcactcatgtggccatgagggacatctcagagagactgcagagatcagaaaaactcatcaaaatggagacctgcaaataagaggaggaagagggaggagagagagcacagaaatcttccaagtggcttcagtgacagaaggggaggagtcaccacctgccatttgcatggaagtgtttttgttcctctggtttattgctcctatttatgcatgcgtgtgcaggatcttcaaaatccaggtaagaaacacagtgaagaactcatctactgcaagcttggccccatccatcagtaccagtgaagagagacaaatcaggatagaaagacatcactaccatctctatggtcagtgatattatggactaatgaataaaaataa
